(12) United States Patent
Inoue (10) Patent No.: US 7,910,324 B2
(45) Date of Patent: Mar. 22, 2011

(54) METHOD OF SCREENING FOR COMPOUNDS WHICH AFFECT THE PROCESSING OF EPHA4 BY γ-SECRETASE

(75) Inventor: Eiji Inoue, Kobe (JP)

(73) Assignee: Eisai R&D Management Co., Ltd., Tokyo (JP)

( * ) Notice: Subject to any disclaimer, the term of this patent is extended or adjusted under 35 U.S.C. 154(b) by 198 days.

(21) Appl. No.: 12/135,307

(22) Filed: Jun. 9, 2008

(65) Prior Publication Data

US 2009/0142788 A1    Jun. 4, 2009

Related U.S. Application Data (60) Provisional application No. 60/942,687, filed on Jun. 8, 2007.

(51) Int. Cl.
*C12Q 1/37* (2006.01)
(52) U.S. Cl. .......................................... 435/23
(58) Field of Classification Search ............... 435/23
See application file for complete search history.

(56) References Cited

U.S. PATENT DOCUMENTS

| 2008/0213250 A1* | 9/2008 | Hopf et al. .................. 424/130.1 |
| 2009/0023158 A1* | 1/2009 | Shapiro et al. .................. 435/7.1 |
| 2009/0163594 A1* | 6/2009 | Shapiro et al. ................. 514/601 |
| 2009/0191580 A1* | 7/2009 | Inoue .............................. 435/23 |
| 2009/0275049 A1* | 11/2009 | Inoue et al. .................... 435/7.2 |
| 2010/0113415 A1* | 5/2010 | Rajapakse et al. ....... 514/210.21 |

FOREIGN PATENT DOCUMENTS

| EP | 1662259 | * | 5/2006 |
| JP | 2003169699 |   | 6/2003 |
| JP | 2006-508653 |   | 3/2006 |
| WO | WO-2004048578 |   | 6/2004 |
| WO | WO 2005/083086 A2 |   | 9/2005 |
| WO | WO-2006061660 |   | 6/2006 |

OTHER PUBLICATIONS

Inoue E. et al. Synaptic Activity Prompts Gamma Secretase Mediated Cleavage . . . J of Cell Biology 185(3)551-564, May 4, 2009.*
Jason Aoto et al., "Bidirectional ephrin/Eph signaling in synaptic functions", Science Direct-Brain Research 1184 (2007) 72-80.
Gary Fox et al., "cDNA cloning and tissue distribution of five human EPH-like receptor protein-tyrosine kinases", Dept of Immunology Amen Center, CA 91320-1789, Oncogene 1995 897-905.
E. Inoue at al., "Synaptic activity prompts γ-secretase-mediated cleavage of EphA4 and dendritic spine formation", J.Cell Biol., 2009. vol. 185, No. 3, p. 551-564.
Sastre et al., "Presenilin-Dependent Gamma-Secretase Processing of Beta-Amyloid Precursor Protein at a Site Corresponding to the S3 Cleavage of Notch," EMBO Reports 2:835-841, 2001.
Yokote et al., "Trans-Activation of EphA4 and FGF Receptors Mediated by Direct Interactions Between Their Cytoplasmic Domains," Proc. Natl. Acad. Sci. U.S.A. 102:18866-18871, 2005.
Extended European Search Report from European Patent Application No. 08765357.2, dated Jun. 7, 2010 (date of completion of search) and Jun. 25, 2010 (date of mailing of report).

* cited by examiner

*Primary Examiner* — Ralph Gitomer
(74) *Attorney, Agent, or Firm* — Clark & Elbing LLP (57) ABSTRACT

The present invention provides a method of screening for compounds which affect the processing of EphA4 by γ-secretase, which includes the following steps:

(i) contacting a first biological composition containing γ-secretase or a biologically active fragment thereof with a second biological composition containing EphA4 in the presence and absence of a candidate compound;
(ii) measuring the cleavage of the EphA4 in the presence and absence of the candidate compound;
(iii) selecting those candidate compounds which affect the cleavage of the EphA4 by γ-secretase; and
(iv) identifying the candidate compounds selected in step (iii) as compounds which affect the processing of EphA4 by γ-secretase.

7 Claims, 2 Drawing Sheets

METHOD OF SCREENING FOR COMPOUNDS WHICH AFFECT THE PROCESSING OF EPHA4 BY γ-SECRETASE

RELATED APPLICATION

This application claims the benefit of the filing date of U.S. Provisional Application Ser. No. 60/942,687 (filed on Jun. 8, 2007), the entirety of such provisional application is incorporated by reference herein.

FIELD OF THE INVENTION

The present invention relates to a screening method using EphA4, which is a novel substrate for γ-secretase, and a kit for use in the method.

BACKGROUND OF THE INVENTION

γ-Secretase is a complex protein (a member of the aspartate protease family) comprising presenilin, nicastrin, Aph-1 ("anterior pharynx defective I") and Pen-2 ("presenilin enhancer 2") as basic components. Presenilin is the catalytic domain; the presenilin gene has been identified as a causative gene for familial Alzheimer's disease (AD). γ-Secretase acts on single-pass transmembrane proteins as its substrates. Representative substrates of γ-secretase are amyloid precursor protein (APP) and Notch. When cleaved by β-secretase at the β-site and by γ-secretase at the γ-site, APP produces amyloid βprotein (Aβ). The thus-produced Aβ is classified into peptides with different lengths depending on the cleavage site in the amino acid sequence (C-terminal side). Of these peptides, Aβ42 which is strongly hydrophobic and ready to aggregate (ready to take the β-sheet structure) exhibits neurotoxicity. It has been considered that this phenomenon may be the major cause of Alzheimer's disease. Recently, however, a report has been made that presenilin 1 (PS1) and presenilin 2 (PS2) double-knockout mice capable of producing no Aβ show AD-like phenotypes such as decrease of synapses and neuronal death; this suggests the existence of a pathogenic mechanism of AD that is independent from APP (see Saura C A, Choi S Y, Beglopoulos V, Malkani S, Zhang D, Shankaranarayana Rao B S, Chattarji S, Kelleher R J 3rd, Kandel E R, Duff K, Kirkwood A, and Shen J., "Loss of presenilin function causes impairments of memory and synaptic plasticity followed by age-dependent neurodegeneration," *Neuron* 42(1):23-36 (Apr. 8, 2004)).

On the other hand, Eph receptor A4 (EphA4) is a member of the receptor tyrosine kinase family, and is a molecule regulating the morphogenesis of post-synapses. It is known that EphA4 knockout or expression of EphA4 dominant-negative mutants causes a decrease in the number of dendritic spines (small, thorn-like protrusions found on dendrites) and makes the spine shape slender (see Murai K K, Nguyen L N, Irie F, Yamaguchi Y, Pasquale E B, "Control of hippocampal dendritic spine morphology through ephrin-A3/EphA4 signaling," *Nat. Neurosci.*; 6(2):153-60 (February 2003)). It is generally proposed that the processes of memory and learning are reflected by the number of and the morphology of the spines.

However, it has never been reported to date that EphA4 is a substrate for γ-secretase.

SUMMARY OF THE INVENTION

It is an object of the present invention to provide a screening method using EphA4, a novel substrate for γ-secretase, in particular a method of screening for compounds which affect the processing of EphA4 by γ-secretase.

The present inventors have proved for the first time that EphA4 is cleaved by γ-secretase in HEK293 cells and primary culture of hippocampal neurons by using a γ-secretase inhibitor (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide. The present inventors have also found for the first time that it is possible to detect the cleavage of EphA4 by using an antibody specific to cleaved EphA4 or an antibody specific to a hemagglutinin tag at the C-terminus of EphA4.

Briefly, the present inventors have demonstrated that a screening method with EphA4 utilizing the activity of γ-secretase upon EphA4 (in particular, cleavage accelerating activity or cleavage inhibiting activity) is effective by showing that the cleavage of EphA4 is inhibited by γ-secretase inhibitor).

An accelerator for the EphA4 degradation activity of γ-secretase that is obtainable by the screening method of the present invention is a compound which accelerates the processing of EphA4 through γ-secretase. An inhibitor for the EphA4 degradation activity of γ-secretase obtainable by the screening method of the present invention is a compound which reduces the processing of EphA4 through γ-secretase. According to the present invention, it has become possible to develop therapeutics for memory disorders of interest (preferably AD) by selecting those compounds which act on γ-secretase selectively.

The present invention provides, but is not limited to, the following embodiments.

In one embodiment, the present invention relates to a method of screening for compounds which affect the processing of EphA4 by γ-secretase. More specifically, the method comprises the following steps: (a) an assay step of examining the cleavage of EphA4 by γ-secretase, wherein a first biological composition containing γ-secretase or a biologically active fragment thereof is contacted with a second biological composition containing the EphA4 of the present invention to thereby measure the cleavage of the EphA4; and (b) a step of secondarily evaluating whether or not candidate compounds are compounds which affect γ-secretase, wherein those candidate compounds which affect the cleavage of the EphA4 by γ-secretase are selected and the thus selected compounds are identified as compounds which affect the processing of EphA4 by γ-secretase.

In another embodiment, the present invention relates to a screening method further comprising, in addition to the above-described steps, a step of evaluating a candidate compound as a compound which inhibits the processing of EphA4 through γ-secretase or an inhibitor for the EphA4 degradation activity of γ-secretase, when EphA4 undegraded product in the presence of the candidate compound was increased relative to EphA4 undegraded product in the absence of the candidate compound.

In still another embodiment, the present invention relates to a screening method further comprising, in addition to the above-described steps, a step of evaluating a candidate compound as a compound which accelerates the processing of EphA4 through γ-secretase or an accelerator for the EphA4 degradation activity of γ-secretase, when EphA4 undegraded product in the presence of the candidate compound was decreased relative to EphA4 undegraded product in the absence of the candidate compound.

In still another embodiment, the present invention relates to a screening method further comprising, in addition to the above-described steps, a step of evaluating a candidate compound as a compound which accelerates the processing of EphA4 through γ-secretase or an accelerator for the EphA4 degradation activity of γ-secretase, when EphA4 cleavage product in the presence of the candidate compound was increased relative to EphA4 cleavage product in the absence of the candidate compound.

In still another embodiment, the present invention relates to a screening method further comprising, in addition to the above-described steps, a step of evaluating a candidate compound as a compound which inhibits the processing of EphA4 through γ-secretase or an inhibitor for the EphA4 degradation activity of γ-secretase, when EphA4 cleavage product in the presence of the candidate compound was decreased relative to EphA4 cleavage product in the absence of the candidate compound.

In still another embodiment, the present invention relates to a screening method further comprising, in addition to the above-described method, a step of measuring the cleavage of APP or a polypeptide comprising a γ-secretase cleavage site of APP (hereinafter, expressed as "polypeptide comprising an APP γ-secretase cleavage site").

In still another embodiment, the present invention relates to a screening method further comprising, in addition to the above-described method, a step of measuring the cleavage of Notch or a polypeptide comprising a γ-secretase cleavage site of Notch (hereinafter, expressed as "polypeptide comprising a Notch γ-secretase cleavage site").

In still another embodiment, the present invention provides a pharmaceutical composition comprising at least one compound identified by the screening method of the present invention and a pharmacologically acceptable carrier. Preferably, the above compound is (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (hereinafter, sometimes referred to as "Compound E").

In still another embodiment, the present invention provides a method of treating a disease or condition in which the processing of EphA4 by γ-secretase is abnormal, comprising administering to a patient in need of treatment (preferably a patient with a condition of dementia (preferably AD)) an effective dose of the compound of the present invention or a pharmaceutical composition comprising the same (preferably a therapeutic for dementia), wherein preferably the dose is effective for altering the EphA4 processing activity of γ-secretase in the cells of the patient.

In still another embodiment, the present invention provides an assay kit for γ-secretase or a screening kit for identifying γ-secretase inhibitor or accelerator, each of which is applicable to the method of the present invention, comprising EphA4, preferably further comprising a substrate for γ-secretase other than EphA4 (preferably APP and/or Notch).

In still another embodiment, the present invention provides a test kit for measuring the processing of EphA4 by γ-secretase, comprising a first biological composition containing γ-secretase or a biologically active fragment thereof and a second biological composition containing EphA4.

According to the present invention, there are provided a method for screening for compounds which affect the processing of EphA4 by γ-secretase and a kit for use in the method. The compound screened by the present invention can be a therapeutic for a memory disorder of interest, in particular dementia (preferably AD).

DETAILED DESCRIPTION OF THE INVENTION

Herein below, the present invention will be described in more detail. The present specification encompasses the contents disclosed in the specification and the drawings of U.S. Provisional Patent Application No. 60/942,687 (filed on Jun. 8, 2007) based on which the present patent application claims priority.

The term "patient" as used herein refers to an animal, preferably a mammal.

The term "mammal" as used herein means any animal classified as mammal, including human and non-human mammals (such as mouse, rat, hamster, guinea pig, rabbit, pig, dog, horse, cattle, monkey, etc.). Preferably, the mammal in the present specification is human. When the mammal is human, the term "patient" include adults and children, and also male and female. Children include newborn infants, infants and adolescents.

The term "γ-secretase" as used herein means an enzyme or a complex composed of a plurality of molecules, each of which is in charge of the production of Aβ by cleaving (degrading) APP within its transmembrane domain. The plurality of molecules comprise at least one molecule selected from presenilin, nicastrin, Aph-1 and Pen-2. Examples of the γ-secretase of the present invention include mouse Presenilin 1 (NM_008943), rat Presenilin1 (D82363), human Presenilin1 (NM_000021), mouse Presenili (NM_011183) rat Presenilin2 (NM_031087), human Presenilin2 (NM_000447), mouse Nicastrin (NM_021607), rat Nicastrin (NM_174864), human Nicastrin (NM_015331), mouse Aph-1 (NM_146104), rat Aph-1 (NM_001014255), human Aph-1 (NM_016022), mouse Pen-2 (NM_025498), rat Pen-2 (NM_001008764) and human Pen-2 (NM_172341). Each component molecule of the γ-secretase of the present invention may be a full-length molecule or a part thereof, as long as that γ-secretase has an enzyme activity equivalent to that of γ-secretase functioning in vivo. Further, the γ-secretase of the present invention may be a mutant γ-secretase. The mutant γ-secretase is a polypeptide composed of full-length component molecules which may have deletion, substitution, insertion and/or addition of one or more (preferable one or several) amino acids, or a polypeptide having an amino acid sequence comprising a combination of such mutations, each of the above polypeptide having an enzyme activity equivalent to that of γ-secretase functioning in vivo.

The term "cleavage of EphA4" as used herein refers to an event in which EphA4, cut by γ-secretase, produces a fragment shorter than the initial EphA4 before cutting. The term "EphA4 undegraded product" used herein refers to a polypeptide which is produced as a result of non-cleavage of EphA4; this polypeptide means the EphA4 polypeptide before degradation by γ-secretase.

The term "biologically active fragment of γ-secretase" as used herein means a fragment having an enzyme activity equivalent to that of γ-secretase functioning in vivo. Examples of such fragments include fragments capable of cleaving APP or EphA4.

It should be noted that sometimes, the term "γ-secretase" as used herein is intended to include the "biologically active fragment of γ-secretase" in the present specification.

The term "EphA4" used herein refers to a known polypeptide which is a regulatory factor for synapse formation and/or maintenance (Murai K K et al., Nat. Neurosci. 2003 February; 6(2):153-60). The EphA4 of the present invention include, but are not limited, to human EphA4 (NM_004438.3 and BC026327), rhesus monkey (*Macaca mulatta*) EphA4 (XM_001106493.1, XM_001106620, XM_001106561, XM_001106876, XM_001106943 and XM_001106806), chimpanzee (*Pan troglodytes*) EphA4 (XM_001164636.1, XM_001164828, XM_526042, XM_001164899, XM_001164862 and XM_001164676), rat EphA4 (XM_244186.4, SEQ ID NO: 2), mouse EphA4 (NM_007936.3, BC052164, AK028509, X65138, BC004782 and AK132203), gray short-tailed opossum (*Monodelphis domestica*) EphA4 (XM_001365826), dog (*Canis familiaris*) EphA4 (XM_536084), chicken (*Gallus gallus*) EphA4 (NM_204781 and Z19059), African clawed frog (*Xenopus laevis*) EphA4 (NM_001085992, L26099 and NM_001096714) and zebrafish (*Danio rerio*) EphA4 (NM_001005919 and XM_001342436). Among them, mammal EphA4 polypeptides are preferable. EphA4 comprises a γ-secretase cleavage site, a transmembrane domain and a kinase activity site in its structure (Aoto, J et al., Brain Res 2006 11). The ligand thereof is the Ephrin A family (Aoto, J et al., Brain Res 2006 11).

In the present invention, EphA4 may be a polypeptide derived from any of the above-listed animals, a recombinant polypeptide or a synthetic polypeptide.

The EphA4 of the present invention may be either a full-length polypeptide or a partial polypeptide thereof, as long as it comprises the γ-secretase cleavage site of EphA4.

Further, in the present invention, EphA4 may be a mutant EphA4. The mutant EphA4 is a full-length EphA4 polypeptide which may have deletion, substitution, insertion and/or addition of one or more (preferable one or several) amino acids, or a polypeptide having an amino acid sequence comprising a combination of such mutations, each of the above polypeptide being functionally substantially identical with EphA4. The polypeptide which is "functionally substantially identical with EphA4" means a polypeptide having an activity of EphA4, for example, a polypeptide which has a cleavage activity in a γ-secretase-dependent manner.

Table 1 below shows correspondence between various animal-derived EphA4 polypeptides and their nucleotide or amino acid sequences. Table 2 below shows correspondence between various animal-derived γ-secretases and their nucleotide or amino acid sequences.

TABLE 1

| Source or Type | Accession No. | Nucleotide Sequence | Amino Acid Sequence |
| --- | --- | --- | --- |
| Rat (*Rattus norvegicus*) | XM_244186 | SEQ ID NO: 1 | SEQ ID NO: 2 |
| Rat EphA4-HA | XM_244186 | SEQ ID NO: 3 | SEQ ID NO: 4 |
| Human | NM_004438 | SEQ ID NO: 5 | SEQ ID NO: 6 |
| (*Homo sapiens*) | BC026327 | SEQ ID NO: 7 | SEQ ID NO: 8 |
| Mouse | NM_007936 | SEQ ID NO: 9 | SEQ ID NO: 10 |
| (*Mus musculus*) | BC052164 | SEQ ID NO: 11 | SEQ ID NO: 12 |
|  | X65138 | SEQ ID NO: 13 | SEQ ID NO: 14 |
|  | BC004782 | SEQ ID NO: 15 | SEQ ID NO: 16 |
|  | AK132203 | SEQ ID NO: 17 | SEQ ID NO: 18 |
| Gray short-tailed opossum (*Monodelphis domestica*) | XM_001365826 | SEQ ID NO: 19 | SEQ ID NO: 20 |
| Dog (*Canis lupus familiaris*) | XM_536084 | SEQ ID NO: 21 | SEQ ID NO: 22 |
| Chimpanzee | XM_001164636 | SEQ ID NO: 23 | SEQ ID NO: 24 |
| (*Pan troglodytes*) | XM_001164828 | SEQ ID NO: 25 | SEQ ID NO: 26 |
|  | XM_526042 | SEQ ID NO: 27 | SEQ ID NO: 28 |
|  | XM_001164899 | SEQ ID NO: 29 | SEQ ID NO: 30 |
|  | XM_001164862 | SEQ ID NO: 31 | SEQ ID NO: 32 |
|  | XM_001164676 | SEQ ID NO: 33 | SEQ ID NO: 34 |
| Rhesus monkey | XM_001106493 | SEQ ID NO: 35 | SEQ ID NO: 36 |
| (*Macaca mulatta*) | XM_001106620 | SEQ ID NO: 37 | SEQ ID NO: 38 |
|  | XM_001106561 | SEQ ID NO: 39 | SEQ ID NO: 40 |
|  | XM_001106876 | SEQ ID NO: 41 | SEQ ID NO: 42 |
|  | XM_001106943 | SEQ ID NO: 43 | SEQ ID NO: 44 |
|  | XM_001106806 | SEQ ID NO: 45 | SEQ ID NO: 46 |
| Chicken (*Gallus gallus*) | NM_204781 | SEQ ID NO: 47 | SEQ ID NO: 48 |
| African clawed frog | NM_001085992 | SEQ ID NO: 49 | SEQ ID NO: 50 |
| (*Xenopus laevis*) | L26099 | SEQ ID NO: 51 | SEQ ID NO: 52 |
|  | NM_001096714 | SEQ ID NO: 53 | SEQ ID NO: 54 |
| Zebrafish | NM_001005919 | SEQ ID NO: 55 | SEQ ID NO: 56 |
| (*Danio rerio*) | XM_001342436 | SEQ ID NO: 57 | SEQ ID NO: 58 |

TABLE 2

| Source or Type | Accession No. | Nucleotide Sequence | Amino Acid Sequence |
| --- | --- | --- | --- |
| Mouse Presenilin 1 (*Mus musculus*) | NM_008943 | SEQ ID NO: 59 | SEQ ID NO: 60 |
| Rat Presenilin 1 (*Rattus norvegicus*) | D82363 | SEQ ID NO: 61 | SEQ ID NO: 62 |
| Human Presenilin 1 (*Homo sapiens*) | NM_000021 | SEQ ID NO: 63 | SEQ ID NO: 64 |

TABLE 2-continued

| Source or Type | Accession No. | Nucleotide Sequence | Amino Acid Sequence |
|---|---|---|---|
| Mouse Presenilin 2 (*Mus musculus*) | NM_011183 | SEQ ID NO: 65 | SEQ ID NO: 66 |
| Rat Presenilin 2 (*Rattus norvegicus*) | NM_031087 | SEQ ID NO: 67 | SEQ ID NO: 68 |
| Human Presenilin 2 (*Homo sapiens*) | NM_000447 | SEQ ID NO: 69 | SEQ ID NO: 70 |
| Mouse Nicastrin (*Mus musculus*) | NM_021607 | SEQ ID NO: 71 | SEQ ID NO: 72 |
| Rat Nicastrin (*Rattus norvegicus*) | NM_174864 | SEQ ID NO: 73 | SEQ ID NO: 74 |
| Human Nicastrin (*Homo sapiens*) | NM_015331 | SEQ ID NO: 75 | SEQ ID NO: 76 |
| Mouse Aph-1 (*Mus musculus*) | NM_146104 | SEQ ID NO: 77 | SEQ ID NO: 78 |
| Rat Aph-1 (*Rattus norvegicus*) | NM_001014255 | SEQ ID NO: 79 | SEQ ID NO: 80 |
| Human Aph-1 (*Homo sapiens*) | NM_016022 | SEQ ID NO: 81 | SEQ ID NO: 82 |
| Mouse Pen-2 (*Mus musculus*) | NM_025498 | SEQ ID NO: 83 | SEQ ID NO: 84 |
| Rat Pen-2 (*Rattus norvegicus*) | NM_001008764 | SEQ ID NO: 85 | SEQ ID NO: 86 |
| Human Pen-2 (*Homo sapiens*) | NM_172341 | SEQ ID NO: 87 | SEQ ID NO: 88 |

The term "substitution" used herein means preferably conservative substitution in which one or more (preferably one or several) amino acid residues are substituted with other chemically similar amino acid residues so that the activity of the peptide is not substantially modified. Examples of conservative substitution include substitution of a hydrophobic residue with other hydrophobic residue and substitution of a polar residue with other polar residue with the same electric charge. Functionally similar amino acids which allow such substitution are known to those skilled in the art for each amino acid. Specifically, examples of non-polar (hydrophobic) amino acids include alanine, valine, isoleucine, leucine, proline, tryptophan, phenylalanine and methionine; examples of polar (neutral) amino acids include glycine, serine, threonine, tyrosine, glutamine, asparagine and cystein. Examples of positively charged (basic) amino acids include arginine, histidine and lysine. Examples of negatively charged (acidic) amino acids include aspartic acid and glutamic acid.

The number of amino acids which may be deleted, substituted, inserted and/or added as described above is, for example, 1 to 30, preferably 1 to 20, more preferably 1 to 10, still more preferably 1 to 5, particularly preferably 1 to 2.

The mutant EphA4 includes those polypeptides which consist of an amino acid sequence having preferably 80% or more, more preferably 85% or more, still more preferably 90% or more, still yet more preferably 95% or more, particularly preferably 98% or more, most preferably 99% or more homology (identity) with the amino acid sequence of SEQ ID NO: 2 and have substantially the same activity as that of EphA4 (e.g., an activity to cause a γ-secretase degradation activity-dependent change). As long as these conditions are satisfied, the mutant EphA4 may be a polypeptide derived from any of the above-listed animals, a recombinant polypeptide or a synthetic polypeptide, as long as the polypeptide.

The identity described above may be values calculated by homology search programs known to those skilled in the art. For example, identity can be calculated by using default parameters in the homology algorithm BLAST (Basic local alignment search tool; http://www.ncbi.nlm.nih.gov/BLAST/) of The National Center for Biotechnology Information (NCBI).

The EphA4 of the present invention includes all EphA4 derivatives comprising at least the γ-secretase cleavage site of EphA4. These polypeptides are particularly useful in detecting and purifying EphA4.

The EphA4 may take any of the following forms: a fusion polypeptide fused to other polypeptide, a tagged or labeled polypeptide or a polypeptide otherwise modified. These polypeptides may be obtained by recombinant DNA techniques, site-directed mutagenesis, treatment with mutagenic agents (such as hydroxylamine), or automated peptide synthesis.

Examples of particularly useful systems as tagged EphA4 polypeptides include, but are not limited to, hemagglutinin (HA) system, glutathione-S-transferase (GST) system, maltose-binding protein system, 6× histidine system, 8× histidine system and the like.

Examples of modifications incorporating the above-mentioned label or other detectable moieties include, but are not limited to, biotin label, radioactive label, fluorescence label, chemiluminescence label and the like. The EphA4 of the present invention may be labeled with one, two or more of these labels.

Examples of antibodies that may be used to monitor the cleavage of EphA4 by γ-secretase include, but are not limited to, the following: an anti-EphA4 antibody; an antibody which recognizes EphA4 undegraded product produced as a result of non-cleavage of EphA4; or an antibody which recognizes EphA4 cleaved product produced as a result of cleavage of EphA4, preferably an antibody which recognizes the intracellular domain of EphA4, more preferably an antibody which recognizes the C-terminal domain of EphA4. When the undegraded product of a tagged EphA4 polypeptide is to be detected, an antibody which recognizes the selected tag may be used. For example, when an HA tag has been added to the C-terminus of EphA4, it is possible to detect the undegradation or cleavage of EphA4 using an anti-HA tag antibody. In this case, the antibody is capable of clarifying the presence and concentration of a C-terminal fragment of EphA4 that is produced as a result of non-cleavage of EphA4 or the presence and concentration of a C-terminal fragment of EphA4 that is produced as a result of cleavage of EphA4.

In a preferred embodiment of the present invention, EphA4 is a rat EphA4 polypeptide, for example, a polypeptide comprising the amino acid sequence as shown in SEQ ID NO: 2. In a still preferred embodiment of the present invention, EphA4 is a rat EphA4 polypeptide to which an HA tag is added. For example, a rat EphA4 polypeptide with an HA tag added at its C-terminus (SEQ ID NO: 4) may be used (Example 1). It is for granted that polypeptides comprising the entire human EphA4 amino acid sequence or a part thereof (e.g., the amino acid sequence as shown in SEQ ID NO: 6 or 8) may also be used in the same manner as rat EphA4 polypeptides.

The present invention further provides a polynucleotide comprising a nucleotide sequence encoding the above-described EphA4. One example of the polynucleotide encoding the EphA4 of the present invention is a polynucleotide encoding a rat EphA4 (e.g., a polynucleotide as shown in SEQ ID NO: 1). In a preferred embodiment of the present invention, the polynucleotide encoding EphA4 is a polynucleotide encoding an HA-tagged rat EphA4 polypeptide. For example, a polynucleotide encoding a rat EphA4 polypeptide with an HA tag added at its C-terminus (SEQ ID NO: 3) may be given (Example 1). It is for granted that polynucleotides comprising the entire human EphA4 nucleotide sequence or a part thereof (e.g., the nucleotide sequence as shown in SEQ ID NO: 5 or 7) may also be used in the same manner as rat EphA4 polynucleotides.

The polynucleotide encoding the EphA4 of the present invention may be a polynucleotide encoding the above-described EphA4 mutant or EphA4 derivative. For example, a polynucleotide which comprises a nucleotide sequence having 80% or more, preferably 85% or more, still more preferably 90% or more, yet still more preferably 95% or more, particularly preferably 98% or more, most preferably 99% or more homology (identity) with the nucleotide sequence as shown in SEQ ID NO: 1 and encodes a polypeptide having substantially the same activity as that of EphA4 may be included.

Further, the polynucleotide encoding the EphA4 of the present invention includes a polynucleotide which hybridizes to a polynucleotide consisting of a nucleotide sequence complementary to the nucleotide sequence as shown in SEQ ID NO: 1 under stringent conditions and yet encodes a polypeptide having substantially the same activity as that of EphA4. The stringent conditions refer to, for example, "2×SSC, 0.1% SDS, 42° C." or "1×SSC, 0.1% SDS, 37° C." as washing conditions after hybridization. As more stringent conditions, "1×SSC, 0.1% SDS, 65° C." or "0.5×SSC, 0.1% SDS, 50° C." may be given, for example. More specifically, a method using Rapid-hyb buffer (Amersham Life Science) may be employed in which pre-hybridization is performed at 68° C. for more than 30 minutes; then, with addition of a probe, a hybrid is formed while keeping the reaction solution at 68° C. for more than 1 hour, followed by washing in 2×SSC, 0.1% SDS at room temperature for 20 minutes 3 times, washing in 1×SSC, 0.1% SDS at 37° C. for 20 minutes 3 times and finally washing in 1×SSC, 0.1% SDS at 50° C. for 20 minutes twice. Alternatively, other method may be employed in which pre-hybridization is performed in Expresshyb Hybridization Solution (CLONTECH) at 55° C. for more than 30 minutes; then, with addition of a labeled probe, the reaction solution is incubated at 37-55° C. for more than 1 hour, followed by washing in 2×SSC, 0.1% SDS at room temperature for 20 minutes 3 times, washing in 1×SSC, 0.1% SDS at 37° C. for 20 minutes once. In these methods, more stringent conditions may be achieved, for example, by raising the temperature of prehybridization, hybridization or the second washing. For example, the temperatures of prehybridization and hybridization may be raised to 60° C., respectively; for more stringent conditions, the temperatures may be raised to 68° C., respectively. Those skilled in the art could appropriately select conditions for obtaining EphA4 isoforms, allelic mutants, and corresponding genes derived from other organisms, by taking into account various conditions such as probe concentration, probe length, reaction time, etc. in addition to the above-described salt concentrations and reaction temperatures.

Such polynucleotides may be obtained by gene amplification techniques, hybridization techniques, recombinant DNA techniques, and the like.

The term "biological composition" used herein means a composition comprising γ-secretase or a biologically active fragment thereof, or EphA4, and is not particularly limited. For example, the biological composition may be a cell-free reconstruction system, a mammal or a part thereof, or a transgenic non-human mammal so engineered to overexpress APP or a part of this transgenic mammal.

In the expressions "first biological composition containing γ-secretase or a biologically active fragment thereof" and "second biological composition containing EphA4" used herein, the γ-secretase and/or EphA4 may be either endogenous or exogenous.

When the γ-secretase or EphA4 is endogenous, the composition may be any composition as long as it contains γ-secretase or EphA4 derived from the above-mentioned animal or a part thereof.

The term "a part of an animal" include tissues, cells, cell lysates, cell membrane fractions or purified membranes of the above-mentioned animal. As examples of the cells, cells in the central nervous system; neurons such as brain-derived neurons, cerebral cortex-derived neurons, cerebral cortex-derived primarily cultured neurons, or hippocampus-derived primarily cultured neurons; or glial cells may be enumerated. The γ-secretase or EphA4 may be in the state of being contained in a mammal or a part thereof. Alternatively, the γ-secretase or EphA4 may be a γ-secretase fraction or an EphA4 fraction of cell lysate prepared from a mammal. The cell lysate may be obtained by subjecting γ-secretase- or EphA4-containing cells to lysis with a hypotonic solution or surfactant, or to sonication or other physical disruption. Optionally, the cell lysate may be purified with some purification means such as columns.

When the γ-secretase or EphA4 is exogenous, the biological composition may be γ-secretase expressing cells or EphA4 expressing cells prepared by allowing host cells to express the whole or a part of the sequences in expression vectors comprising a polynucleotide encoding the individual molecules constituting γ-secretase or a polynucleotide encoding EphA4. Alternatively, the biological composition may be the γ-secretase fraction of a cell lysate derived from γ-secretase expressing cells, or the EphA4 fraction or cell membrane fraction of a cell lysate derived from EphA4 expressing cells. The cell lysate may be obtained by subjecting γ-secretase- or EphA4-containing cells to lysis with a hypotonic solution or surfactant, or to sonication or physical disruption. Optionally, the cell lysate may be purified with some purification means such as columns. The expression vector may be a vector which is transformed or transfected into a host cell and temporarily expresses the gene of interest. Alternatively, the expression vector may be a vector which is integrated into the genome of a host cell and expresses the gene of interest stably.

The term "transformation" or "transfection" used herein means any and all methods which change DNA contents in eukaryotic cells or microorganisms. These methods include calcium phosphate transfection, protoplast fusion transfection, electroporation transfection, DEAE-dextran transfection, liposome transfection, polybrene transfection and direct microinjection transfection (Sambrook et al., *Molecular Cloning* 3: 16.30-16.31 (1989)).

The host cell into which the above-described expression vector is to be transformed or transfected may be any cell (or cell line) or microorganism capable of expressing the gene of interest. Known cultured cells may be used as host cells. Examples of mammal cells or cell lines which may be used as host cells include HEK 293 cells, Chinese hamster ovary (CHO) cells, fibroblast cells, primary endothelial cells (HU-VEC cells), human glioma cells, HeLa cells, COS cells, PC12 cells, lymphoblast cells, melanoma cells, hybridoma cells, oocytes and embryonic stem cells. Examples of known microorganisms which may be used as host cells include *Escherichia coli* and yeast. Insect cells such as BmN4 cells may also be used.

The expression vector used in the above-described transformation or transfection is not particularly limited as long as the vector comprises a polynucleotide encoding the individual molecules constituting γ-secretase or a polynucleotide encoding EphA4. Such an expression vector may be a plasmid obtainable by introducing the polynucleotide into a known expression vector selected appropriately depending on the host cell to be used.

Examples of the above-mentioned known expression vector include pUC, pTV, pGEX, pKK or pTrcHis for *E. coli*; pEMBLY or pYES2 for yeast; pcDNA3, pMAMneo and pBabe Puro for CHO cells, HEK293 cells or COS cells; and a vector comprising the polyhedrin promoter of *Bombyx mori* nuclear polyhedrosis virus (BmNPV) (such as pBD283) for BmN4 cells.

Since a promoter functions effectively for giving a strong transcription activity in mammal cells, the expression plasmid preferably comprises a promoter. Examples of promoters include CMV immediate early promoter, retrovirus promoters (e.g., LTR from MLV or MMTV), promoters of SV40, RSV LTR, HIV-1 LTR and HIV-2 LTR, adenovirus promoters (e.g., those from E1A region, E2A region or MLP region), and promoters of AAV LTR, cauliflower mosaic virus, HSV-TK and avian sarcoma virus.

The above-described transformed or transfected host cell is not particularly limited as long as the host cell comprises a polynucleotide encoding the individual molecules constituting γ-secretase or a polynucleotide encoding EphA4. For example, the transformed cell may be a transformant in which the polynucleotide has been integrated into the chromosome thereof. Alternatively, the transformed cell may be a transformant comprising the polynucleotide in the form of a plasmid. It is also possible that the transformed cell is a transformant which is not expressing γ-secretase or EphA4. These transformants may be obtained by transforming a desired host cell with the above-mentioned plasmid or the above-described polynucleotide per se.

A cell containing the above-described γ-secretase and/or EphA4 is not particularly limited as long as the cell is capable of expressing γ-secretase and/or EphA4 on the surface of its cell membrane. As examples of such cells, a cell expressing endogenous γ-secretase and endogenous EphA4, a cell expressing γ-secretase and EphA4 one of which is endogenous and the other is exogenous or a cell expressing exogenous γ-secretase and exogenous EphA4 may be given. Such cells may also be obtained by culturing under conditions which allow expression of γ-secretase and/or EphA4. Alternatively, such cells may be obtained by injecting into an appropriate cell an RNA encoding the individual molecules constituting γ-secretase and/or an RNA encoding EphA4 and culturing the resultant cell under conditions which allow expression of γ-secretase and/or EphA4.

The above-described cell membrane fraction may be obtained, for example, by disrupting cells expressing the γ-secretase or EphA4 of the present invention and isolating cell membrane-rich fractions. As methods for disrupting cells, homogenizing in a homogenizer; disrupting in a Waring blender or Polytron; disrupting by sonication; ejecting cells from a thin nozzle while applying pressure with a French press; and so on may be used. As methods for fractionating cell membrane, fractionation methods with centrifugal force such as differential centrifugation or density gradient centrifugation may be used.

For purification, a known method for protein purification may be used. The method comprises a step of crudely fractionating cells into polypeptide fractions and non-polypeptide fractions. After the γ-secretase or EphA4 of the present invention has been isolated from other polypeptides with a column or the like, the desired γ-secretase or EphA4 is further purified by chromatography or electrophoresis to thereby achieve partial purification or complete purification (or homogeneity by purification). Examples of analysis methods particularly suitable for preparation/purification of pure peptides include precipitation using ammonium sulfate, PEG, antibodies, etc.; centrifugation after thermal denaturation; chromatography step (e.g., ion exchange chromatography, gel filtration chromatography, reversed-phase chromatography, hydroxyapatite chromatography, affinity chromatography, fast protein liquid chromatography (FPLC), high performance liquid chromatography (HPLC) or immobilized metal ion affinity chromatography (IMAC)); isoelectric focusing; gel electrophoresis; SDS (sodium dodecyl sulfate)-polyacrylamide electrophoresis (SDS-PAGE); and a combination of these methods and other method. Alternatively, γ-secretase or EphA4 may be tagged in advance; then, a crude polypeptide may be applied to a purification column to which a protein that recognizes the tag is bound; the desired γ-secretase or EphA4 adsorbed onto the column may be desorbed from the column by feeding an appropriate solvent thereinto. Various purification steps may be performed in a different order, or some of the steps may be omitted. A preferable method for evaluating the purity of a fraction is a method in which the specific activity of the fraction is calculated and compared with the specific activity of the first extract, followed by calculation of the magnitude of purity for evaluation.

The term "APP" used herein β-amyloid precursor protein (βAPP) or a mutant thereof. APP is a single-pass transmembrane protein comprising an Aβ domain in its C-terminal region, expressed in a large variety of cells in many mammals. In human, APP is encoded by the gene APP located in the long arm of chromosome No. 21 and has three major isotypes (APP695, APP751 and APP770). APP695, APP751 and APP770 consist of 695, 751 and 770 amino acid residues, respectively. Examples of APP proteins include human APP695 (NM_201414, NP_958817 and P05067-4), human APP751 (NM_201413, NP_958816 and P05067-8), human APP770 (NM_000484, NP_000475, P05067-1 and P05067), mouse APP695 (NM_007471, NP_031497 and P12023-2), mouse APP751 (P12023-3), mouse APP770 (AY267348, AAP23169, P12023-1 and P12023), rat APP695 (P08592-2), rat APP751 (P08592-7) and rat APP770 (NM_019288, NP_062161, P08592-1 and P08592). Examples of APP mutants include Swedish FAD double mutant, London mutant, valine717 to phenylalanine mutant, valine717 to isoleucine mutant and valine717 to glycine mutant.

The term "Aβ" used herein means the term β-amyloid protein, amyloid β protein, β-amyloid peptide, amyloid β peptide or amyloid beta. For example, Aβ is a peptide consisting of about 33-40 amino acids residues in human APP695 amino acid isotype. Preferably, Aβ includes any peptide comprising a part or all of the amino acid residues from positions 597 to 640 in APP, and means every peptide produced from APP by its N-terminal protein degradation and subsequent C-terminal protein degradation. Aβ40 and Aβ42 are peptides comprising 40 amino acid residues and 42 amino acid residues, respectively.

The term "Notch" used herein refers to one of the competing substrates for γ-secretase belonging to the cell surface receptor Notch family. For example, human Notch 1 (AF308602.1), mouse Notch 1 (NM_008714.2) and rat Notch 1 (NM_001105721.1) may be enumerated. Since Notch 1 has an important function in hematopoiesis, inhibition of the processing of Notch 1 may potentially cause immunodeficiency and anemia.

The term "candidate compound" used herein means a compound which is tested in the compound screening method. Although every molecule may be used as a candidate compound, preferably a compound capable of changing the activity of γ-secretase (preferably the activity of γ-secretase of mammals) is used. The candidate compound is one or more compounds contained in expression products of gene libraries; natural or synthetic low molecular weight compound libraries; nucleic acids (oligo DNA or oligo RNA); natural or synthetic peptide libraries; antibodies; substances released from bacteria (including those released from bacteria as a result of metabolism); cell (microorganism, plant cell or animal cell) extracts; cell (microorganism, plant cell or animal cell) culture supernatants; purified or partially purified peptides; extracts from marine organisms, plants or animals; soils; or random phage peptide display libraries. The above-described compound may be either a novel compound or a known compound. Further, the above-described compound may be a compound modified by conventional chemical means, physical means and/or biochemical means. For example, the above-described compound may be a structural analogue which is obtained by subjecting the initial compound to direct chemical modification (such as acylation, alkylation, esterification or amidation) or random chemical modification. The candidate compound may also be a compound identified by pharmacophore search of the above-described compound or structure comparison programs with computer. The candidate compound may be in the form of a salt. Further, the candidate compound or a salt thereof may be in the form of a solvate (including hydrate).

Further, the candidate compound may be a known γ-secretase accelerator or γ-secretase inhibitor involved in the processing of APP and/or the processing of Notch, or a structural analogue of the above accelerator or inhibitor. A known compound which accelerates or inhibits the activity of γ-secretase and/or the processing of APP and/or the processing of Notch may be a compound that can be designed through rational drug design. For example, DAPT (N—[N-(3,5-difluorophenacetyl)-L-alanyl]-S-phenylglycine t-butyl ester), CM256 and (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Alexis Biochemicals) may be enumerated.

The expression "compound which affects the processing of EphA4 by γ-secretase" as used herein means either a compound which inhibits the EphA4 cleavage activity by γ-secretase (γ-secretase inhibitor) or a compound which accelerates the EphA4 cleavage activity by γ-secretase (γ-secretase accelerator). It should be noted that γ-secretase inhibitor includes antagonist and that γ-secretase accelerator includes agonist. γ-Secretase inhibitor and γ-secretase accelerator also include those compounds which alter the cleavage site of EphA4 cleavage products by γ-secretase to thereby produce EphA4 cleavage products with different peptide lengths.

The term "salt" as used herein refers to a pharmacologically acceptable salt, and is not particularly limited as long as it forms a pharmacologically acceptable salt with the above-described compound. Preferred examples thereof are hydrohalogenic acid salts (such as hydrofluoride, hydrochloride, hydrobromide or hydroiodide), inorganic acid salts (such as sulfate, nitrate, perchlorate, phosphate, carbonate or hydrogencarbonate), organic carboxylic acid salts (such as acetate, oxalate, maleate, tartrate, fumarate or citrate), organic sulfonic acid salts (such as methanesulfonate, trifluoromethanesulfonate, ethanesulfonate, benzenesulfonate, toluenesulfonate or camphorsulfonate), amino acid salts (such as aspartate or glutamate), quaternary amine salts, alkali metal salts (such as lithium salt, sodium salt or potassium salt) and alkaline earth metal salts (such as magnesium salt or calcium salt).

According to the first embodiment of the present invention, there are provided (a) an assay method for examining the cleavage of EphA4 and (b) a method of secondarily evaluating whether or not a candidate compound is a compound which affects γ-secretase (screening method) utilizing the assay method. As a method of the present invention, the method as described below is provided. The method of the present invention is characterized by the use of EphA4, a novel substrate for γ-secretase. The method of the present invention may be performed in an in vitro appropriate cell line or a cell-free system.

The first embodiment of the present invention is capable of evaluating the cleavage of EphA4 by γ-secretase after incubating EphA4 and γ-secretase in the presence and absence of a candidate compound.

The method of screening for compounds which affect the processing of EphA4 by γ-secretase (which is the first embodiment of the present invention) comprises the following steps:

(i) contacting a first biological composition containing γ-secretase or a biologically active fragment thereof with a second biological composition containing EphA4 in the presence of a candidate compound or EphA4 in the absence of a candidate compound (ii) measuring the cleavage of the EphA4 in the presence and absence of the candidate compound;

(iii) selecting those candidate compounds which affect the cleavage of the EphA4 by γ-secretase; and (iv) identifying the candidate compounds selected in step (iii) as compounds which affect the processing of EphA4 by γ-secretase.

The method according to this embodiment may be performed in an appropriate cell line containing γ-secretase and EphA4 or a cell-free system containing γ-secretase and EphA4.

The cell line containing γ-secretase and EphA4 may be either a cell line expressing endogenous genes or a cell line containing an exogenous gene(s). It is possible to contact a first biological composition containing γ-secretase with a second biological composition containing EphA4 by culturing a cell containing γ-secretase and EphA4 in an appropriate medium in the presence and absence of a candidate compound and incubating the cell under reaction conditions which allow the cleavage of EphA4 by γ-secretase activity. If a cell line containing an exogenous gene(s) is used, the above-described contact may be performed under culture conditions which allow the expression of the exogenous gene. It is also possible to apply conditions that allow the cleavage of other γ-secretase substrate, e.g., reaction conditions known to those skilled in the art when the substrate is APP.

Examples of reaction conditions are enumerated below. For cell lines expressing endogenous genes, in case of primary culture of neurons, culture conditions are in MEM (Invitrogen) medium supplemented with 5% FBS (Hyclone), 1×B27 Supplement (Invitrogen), 0.5 mM L-glutamine (Invitrogen), 25 μg/ml insulin (SIGMA) and 8 μM AraC (SIGMA); under 5% $CO_2$; and at 37° C. For cell lines containing an exogenous gene(s), in the case of HEK293 cell line, culture conditions are in 10% FBS (Hyclone)/DMEM (Invitrogen), under 5% $CO_2$ and at 37° C.

In cell-free systems, a first biological composition containing γ-secretase or a biologically active fragment thereof (e.g., cell membrane fraction containing γ-secretase) and a second biological composition containing EphA4 (e.g., cell membrane fraction containing EphA4) may be contacted with each other by incubating these compositions by mixing them in the presence and absence of a candidate compound. These compositions may be mixed under reaction conditions which allow the cleavage of EphA4 by γ-secretase activity, e.g., 10 mM HEPES, pH 7.4, 150 mM NaCl, 10% glycerol, 5 mM EDTA, 5 mM 1,10-phenanthroline, 10 μg/ml phosphoramidon, Complete protease inhibitor cocktail (Roche Biochemicals) (Tomita et al., Molecular Neurodegeneration 2006 1:2). Alternatively, these compositions may be mixed under conditions which allow the cleavage of other γ-secretase substrate, e.g., reaction conditions known to those skilled in the art when the substrate is APP. γ-Secretase or EphA4 may be a purified γ-secretase or EphA4, a biologically active fragment of γ-secretase or EphA4, an analogue of γ-secretase or EphA4, or a mutant of γ-secretase or EphA4.

When a first biological composition containing γ-secretase is contacted with a second biological composition containing EphA4 as described above, EphA4 cleavage reaction by γ-secretase occurs.

The candidate compound may be added generally within a range from approx. 1 nM to 1 mM, usually within a range from approx. 10 μM to 1 mM. In order to identify a compound which changes the cleavage of EphA4 by γ-secretase, the steps described above are performed in the presence and absence of a candidate compound. Then, the EphA4 cleavage activity of γ-secretase in the presence of the candidate compound is compared with that activity in the absence of the candidate compound to evaluate the ability of the candidate compound. Thus, a compound which changes the cleavage of EphA4 by γ-secretase is identified. Even a slight change in the quantity or degree of EphA4 in the presence of a candidate compound indicates that the EphA4 cleavage activity of γ-secretase has been changed in the presence of the candidate compound. Therefore, the candidate compound can be identified as a compound which affects the processing of EphA4 by γ-secretase. For example, a compound which increases EphA4 cleavage product or decreases EphA4 undegraded product compared with control is evaluated as an accelerator for the EphA4 degradation activity of γ-secretase. On the other hand, a compound which decreases EphA4 cleavage product or increases EphA4 undegraded product compared with control is evaluated as an inhibitor for the EphA4 degradation activity of γ-secretase. The accelerator for EphA4 degradation activity obtained by the method of the present invention is potentially useful for treatment of AD.

When EphA4 is tagged, it is possible to detect the undegraded product or cleavage product of EphA4 using a substance which binds to the tag (e.g., antibody). For example, EphA4 with a hemagglutinin tag added to its C-terminus may be detected using a known anti-HA antibody.

Analysis of EphA4 cleavage is performed by measuring an indicator of cleavage for one or both of the N-terminal fragment and C-terminal fragment of EphA4.

For analyzing the cleavage of EphA4 by γ-secretase, the following antibodies may be used: anti-EphA4 antibodies; antibodies recognizing an EphA4 derivative (EphA4 undegraded product) before degradation by γ-secretase, produced as a result of non-cleavage of EphA4; antibodies recognizing an EphA4 cleavage product produced as a result of cleavage of EphA4; or antibodies recognizing the intracellular domain of EphA4.

When an undegraded product of tagged EphA4 and/or a cleavage product of tagged EphA4 is to be detected, antibodies to the selected tag may be used.

For example, when an undegraded product of EphA4 polypeptide is to be detected, an HA tag may be added to the C-terminus of EphA4 polypeptide, followed by detection of the undegraded product with an anti-HA tag antibody. In this case, it is possible to clarify the presence and concentration of a C-terminal fragment of EphA4 produced as EphA4 undegraded product, by detecting and quantitatively determining the HA tag. When EphA4 or tagged EphA4 is labeled, detection may be performed by detecting or quantitatively determining the label.

On the other hand, when a cleavage product of EphA4 polypeptide is to be detected, the membrane fraction is purified from EphA4-expressing cells; then, the purified membrane fraction is subjected to cleavage reaction by γ-secretase to thereby allow the EphA4 cleavage product to be released from the membrane fraction. When this reaction product is centrifuged, the EphA4 undegraded product is precipitated into the membrane fraction. Thus, the membrane fraction and other fractions can be separated. By detecting the released fragment, the EphA4 cleavage product can be detected. For this detection, an antibody recognizing the intracellular domain of EphA4 is used when endogenous EphA4 is used. When exogenous recombinant EphA4 is used, a cDNA encoding EphA4 with a tag sequence added to its C-terminus is used to express the recombinant EphA4. Then, the EphA4 cleavage product is detected using an antibody that recognizes the tag. The tag is not particularly limited. For example, HA, Myc, FLAG or the like may be used.

The antibody to EphA4 is not particularly limited as long as the antibody recognizes EphA4 and is preferably an antibody which recognizes the intracellular domain of EphA4. For example, the antibody described in Tremblay et al., J. Comp. Neurol 501 691-702 or a commercial anti-rat EphA4 antibody (Upstate, Zymed or Santacruze) may be used.

Those skilled in the art could prepare an antibody which recognizes EphA4 by immunizing an animal with an immunogen (antigen) and following the conventional, general procedures for preparing monoclonal antibodies. As the immunogen, for example, EphA4 or a fragment thereof, or a fusion protein prepared by adding a tag or label to EphA4 or a fragment thereof may be used.

For example, a non-human mammal is immunized with the immunogen alone or, if necessary, together with Freund's adjuvant. Polyclonal antibodies may be obtained from the serum collected from the immunized animal. Monoclonal antibodies may be obtained by fusing antibody producing cells from the immunized animal with myeloma cells without autoantibody producing ability to prepare fusion cells (hybridomas), cloning the hybridomas, and selecting those clones which produce a monoclonal antibody showing specific affinity to the antigen used for immunizing the animal. The preparation of monoclonal antibodies from hybridomas may be performed in vitro. Alternatively, the preparation may be performed in vivo in a non-human mammal, preferably mouse or rat, more preferably in the abdominal dropsy in mouse. Monoclonal antibodies may be isolated from the resultant culture supernatant or the abdominal dropsy of the mammal. The isolation and purification of monoclonal antibodies may be performed by subjecting the above-mentioned culture supernatant or abdominal dropsy to methods such as saturated ammonium sulfate precipitation, euglobulin precipitation, caproic acid method, caprilic acid method, ion exchange chromatography (DEAE, DE52, etc.), or affinity column chromatography using anti-immunoglobulin column or protein A column. The monoclonal antibody include those monoclonal antibodies consisting of heavy chains and/or light chains having the amino acid sequences which have deletion, substitution or addition of one or several amino acids in the heavy chains and/or light chains constituting the initial antibody.

In another embodiment of the present invention, it is possible to evaluate whether or not a candidate compound affects the processing of APP and/or Notch, in parallel with, simultaneously with, or before or after the above-described first embodiment of the present invention. For example, a step of measuring the cleavage of APP or a polypeptide containing an APP cleavage site by γ-secretase (i.e., polypeptide containing APP γ-secretase cleavage site) may be included in parallel with, simultaneously with, or before or after the above-described method of the present invention. Further, a step of measuring the cleavage of Notch or a polypeptide containing a Notch cleavage site by γ-secretase (i.e., polypeptide containing Notch γ-secretase cleavage site) may be included.

By including such steps, it is possible to evaluate whether or not a candidate compound selectively acts on the processing of EphA4 compared to the processing of APP and/or Notch. The expression "selectively act on" used herein means to have more inhibitory effect or accelerating effect upon the cleavage of substrate EphA4 by γ-secretase than upon the cleavage of other substrate(s). Specifically, according to this embodiment of the present invention, it is possible to identify a compound which selectively acts only on the processing of EphA4; a compound which selectively acts only on the processing of APP; a compound which selectively acts only on the processing of Notch; or a compound which selectively acts on the processing of APP and EphA4.

As a candidate compound in drug development, a compound which acts in the same manner as metabolic activity in healthy animals in vivo or a compound which regulates the metabolic activity is preferable. A preferable example of such a candidate compound is a compound which inhibits the production of Aβ42 by inhibiting the APP cleavage activity of γ-secretase, does not inhibit the EphA4 cleavage activity of γ-secretase, and does not inhibit the Notch cleavage activity of γ-secretase. Another preferable example is a compound which inhibits the production of Aβ42 by accelerating the production of Aβ40 through acceleration of the APP cleavage activity of γ-secretase; accelerates the degradation of EphA4 by accelerating the EphA4 cleavage activity of γ-secretase; and does not inhibit the Notch cleavage activity of γ-secretase.

As methods for measuring the cleavage by γ-secretase of APP, Notch or a polypeptide containing an APP or Notch γ-secretase cleavage site, assay methods known to those skilled in the art may be applicable (Song et al. PNAS 96:6959-6963 (1999); Moehlmann et al. PNAS 99:8025-8030 (2002)). For example, a first biological composition containing γ-secretase or a biologically active fragment thereof may be contacted with a biological composition containing APP or a polypeptide containing an APP γ-secretase cleavage site or a biological composition containing Notch or a polypeptide containing a Notch γ-secretase cleavage site in the presence and absence of a candidate compound, and then may be measured the cleavage of the APP or the polypeptide containing an APP γ-secretase cleavage site or the cleavage of the Notch or the polypeptide containing a Notch γ-secretase cleavage site. This measurement may be performed by measuring the cleavage product from the APP or the polypeptide containing an APP γ-secretase cleavage site or the cleavage product from the Notch or the polypeptide containing a Notch γ-secretase cleavage site. As one example of the cleavage product from APP or a polypeptide containing an APP γ-secretase cleavage site, Aβ may be given. The quantity of Aβ may be measured, and changes in the quantity between the presence and absence of the candidate compound may be compared. Alternatively, the degree of cleavage and the quantity of cleavage product may be measured by using a known antibody which recognizes the cleavage product from APP or a polypeptide containing an APP γ-secretase cleavage site or the cleavage product from Notch or a polypeptide containing a Notch γ-secretase cleavage site. As the antibody which recognizes the cleavage product from APP or a polypeptide containing an APP γ-secretase cleavage site, commercial antibodies (Sigma or Chemicon) may be used. The measurement may be performed, for example, by Western blotting. As the antibody which recognizes the cleavage product from Notch or a polypeptide containing a Notch γ-secretase cleavage site, commercial antibodies (Santa Cruz Biotechnology) may be used. The measurement may be performed, for example, by Western blotting.

The method of the present invention also includes a high through put screening (HTS) known to those skilled in the art, which tests a large number of compounds simultaneously (see U.S. Pat. No. 5,876,946; U.S. Pat. No. 5,902,732; Jayawickreme and Kost, Curr. Opin. Biotechnol. 8:629-634 (1997); Houston and Banks, Curr. Opin. Biotechnol. 8:734-740 (1997)).

The method of the present invention also includes the use of known model animals. It is possible to analyze the in vivo effect of a compound selected by the in vitro method of the present invention by using, for example, an APP processing and/or AD non-human model. APP transgenic non-human animal models are well-known in the art. One example thereof is Tg2576 mouse (J. Neurosci. 21(2):372-381 (2001); J. Clin. Invest. 112:440-449 (2003)). For example, the following analyses may be made after administering to Tg2576 mouse a known γ-secretase inhibitor DAPT, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Alexis Biochemicals) or a compound of the present invention: evaluation by a method of measuring the Aβ quantities in the brain, cerebrospinal fluid and serum of the mouse (J. Pharmacol. Exp. Ther. 305:864-871 (2003); pathological examination of changes in the brain (e.g., changes in Aβ yield, the degree of cerebral atrophy, etc.) resulted from changes in γ-secretase activity; and evaluation of the survival ratio, momentum or food consumption of the mouse.

The pharmaceutical composition comprising the compound identified by the method of the present invention, preferably the AD therapeutic of the present invention, may be administered to patients in various forms through an oral or parenteral (e.g., intravenous injection, muscle injection, subcutaneous administration, rectal administration or transdermal administration) route. Therefore, the pharmaceutical composition comprising the compound of the present invention may be formulated into various preparations using a pharmacologically acceptable carrier by a conventional method depending on the administration route, though the pharmaceutical composition may be used alone.

Preferred dosage forms include oral preparations such as tablets, powders, subtle granules, granules, coated tablets, capsules, syrups and troches; and parenteral preparations such as inhalants, suppositories, injections (including drops), ointments, eye drops, ophthalmic ointments, nasal drops, ear drops, cataplasms, and lotions and liposomes.

Examples of carriers used in the formulation include conventionally used fillers, binders, disintegrants, lubricants, coloring agents and flavoring agents, as well as stabilizers, emulsifiers, absorbefacients, surfactants, pH adjusting agents, antiseptics, antioxidants, expanders, wetting agents, surface activators, dispersing agents, buffers, preservatives, dissolution aids and analgesic agents according to necessity. They can be formulated according to a conventional procedure using components commonly used as raw materials for pharmaceutical preparations. Examples of nontoxic these components which may be used in the present invention include animal and vegetable oils such as soybean oil, beef tallow and synthetic glycerides; hydrocarbons such as liquid paraffins, squalane and solid paraffins; ester oils such as octyldodecyl myristate and isopropyl myristate; higher alcohols such as cetostearyl alcohol and behenyl alcohol; silicone resins; silicone oils; surfactants such as polyoxyethylene fatty acid esters, sorbitan fatty acid esters, glycerin fatty acid esters, polyoxyethylene sorbitan fatty acid esters, polyoxyethylene hydrogenated castor oils and polyoxyethylene-polyoxypropylene block copolymers; water-soluble polymers such as hydroxyethyl cellulose, polyacrylic acids, carboxyvinyl polymers, polyethylene glycol, polyvinylpyrrolidone and methylcellulose; lower alcohols such as ethanol and isopropanol; polyhydric alcohols (polyols) such as glycerol, propylene glycol, dipropylene glycol, sorbitol and polyethylene glycol; sugars such as glucose and sucrose; inorganic powders such as silicic anhydride, magnesium aluminium silicate and aluminium silicate; inorganic salts such as sodium chloride and sodium phosphate; and purified water.

The fillers include, for example, lactose, fructose, corn starch, white sugar, glucose, mannitol, sorbitol, crystalline cellulose and silicon dioxide. The binders include, for example, polyvinyl alcohol, polyvinyl ether, methylcellulose, ethylcellulose, gum arabic, gum tragacanth, gelatin, shellac, hydroxypropyl methylcellulose, hydroxypropyl cellulose, polyvinylpyrrolidone, polypropylene glycol-polyoxyethylene block polymers and meglumine. The disintegrants include, for example, starch, agar, gelatin powder, crystalline cellulose, calcium carbonate, sodium hydrogencarbonate, calcium citrate, dextrin, pectin and carboxymethylcellulose calcium. The lubricants include, for example, magnesium stearate, talc, polyethylene glycol, silica and hardened vegetable oils. The coloring agents may be any coloring agents which are approved to be added to pharmaceutical preparations. The flavoring agents include, for example, cocoa powder, menthol, aromatic powder, peppermint oil, camphol and cinnamon powder. The above-listed components may be in the form of a salt or solvate thereof.

The oral preparation is produced by mixing the compound of the present invention with a filler, and if necessary, a binder, disintegrant, lubricant, coloring agent, flavoring agent, etc. and formulating the mixture according to conventional procedures into, for example, a powder, subtle granules, granules, tablet, coated tablet, capsules or the like. Resultant tablets and granules can be appropriately coated with, for example, sugar according to necessity. The syrups and injection preparations can be prepared according to conventional procedures by adding a pH adjusting agent, solubilizer, and isotonizing agent, and if necessary, a dissolution aid, stabilizer, etc. The external preparations can be produced according to conventional procedures not specifically limited. Base materials which may be used in the present invention include various raw materials conventionally used in pharmaceutical preparations, quasi drugs and cosmetics. Such raw materials include, for example, animal and vegetable oils, mineral oils, ester oils, waxes, higher alcohols, fatty acids, silicone oils, surfactants, phospholipids, alcohols, polyhydric alcohols, water-soluble polymers, clay minerals and purified water. If necessary, pH adjusting agents, antioxidants, chelating agents, antiseptics and antimolds, coloring agents, flavors, or the like can be added. In addition, components such as blood-flow accelerators, bactericides, anti-inflammatory agents, cell activators, vitamins, amino acids, humectants, keratolytic agents or the like be added according to necessity. The ratio of the active ingredient to carriers may vary from 1 to 90% by weight. When the compounds used in the present invention, the peptides used in the present invention or the polynucleotides used in the present invention are used in the above-described treatment, it is preferable to use those compounds, peptides or polynucleotides purified to 90% or more, preferably 95% or more, more preferably 98% or more, still more preferably 99% or more.

The effective dose of the pharmaceutical composition comprising the compound of the present invention varies depending on the severity of symptom, the age, sex and body weight of the patient, administration mode, type of the salt, specific type of the disease and other factors. Generally, the pharmaceutical composition may be administered to an adult (body weight: 60 kg) in one to several divided doses at a daily dose of about 30 μg to about 10 g, preferably 100 μg to 5 g, and more preferably 100 μg to 100 mg for oral administration, or at a daily dose of about 30 μg to about 1 g, preferably 100 μg to 500 mg, and more preferably 100 μg to 30 mg for injection administration. Considering that efficacy varies depending on the administration route, the required dose is expected to vary widely. For example, it is expected that oral administration requires a higher dose than intravenous injection. When administered to children, the dose may be smaller than the dose for adults. These variations in the dose level can be adjusted by standard empirical optimization procedures which are well understood in the industry.

The term "treatment" as used herein generally means a method for obtaining a desired pharmacological and/or physiological effect. The effect may be prophylactic in terms of completely or partially preventing a disease and/or a symptom and may be therapeutic in terms of partially or completely curing a disease and/or an adverse effect attributed to the disease. The term "treatment" as used herein covers any treatment of a disease in a patient, preferably a human, and includes at least one treatment selected from the following (a) to (c):

(a) preventing a disease or a symptom from occurring in a patient who may be predisposed to the disease but has not yet been diagnosed as having it;

(b) inhibiting a disease symptom, i.e. preventing or delaying its progress; or (c) relieving a disease symptom, i.e. causing regression or elimination of the disease or symptom, or causing reversal of the progress of the disease.

For example, as clinical symptoms of AD, progressive disorientation, memory loss and aphasia are enumerated. Finally, disablement, speech loss and akinesia occur. Pathological signs of AD include neurofibrillary tangle, senile plaques and amyloid angiopathy. To prevent the progress of AD is interpreted to mean to prevent the onset or further progress of the clinical symptoms and/or pathological signs of AD. For example, in patients who do not have the clinical symptoms or pathological signs of AD, it is possible to prevent the progress of clinical symptoms or pathological signs. In patients suffering from mild AD, it is possible to prevent the development of more severe AD forms. To delay the progress of AD is interpreted to mean to delay the point of onset of AD-related symptoms and/or pathological signs, or to reduce the speed of progress of AD that is determined by the speed of progress of clinical symptoms and pathological signs. To reverse the progress of AD is interpreted to mean to relieve the severity of AD symptoms, i.e., to change the severity of AD conditions of patients from severe to mild. At that time, the change to mild is indicated by decrease of clinical symptoms or pathological signs.

Diagnosis of AD in patients may be performed by various known methods. Typically, AD is diagnosed by combining clinical and pathological assessments. For example, the progress or severity of AD may be judged using Mini Mental State Examination (MMSE) (Mohs et al. (1996) Int Psychogeriatr 8: 195-203), Alzheimer's Disease Assessment Scale-Cognitive Subscale (ADAS-cog) (Galasko et al., (1997) Alzheimer Dis Assoc Disord, 11 suppl 2: S33-9), Alzheimer's Disease Cooperative Study-Activities of Daily Living (ADCS-ADL) (McKhann et al., (1984) Neurology 34: 939-944) and Criteria of National Institute of Neurologic Communicative Disorders and Stroke-Alzheimer's Disease and Related Disorders Association (NINCDS-ADRDA) (Folstein et al., (1975) J Psychiatr Res 12: 189-198; McKhann et al., (1984) Neurology 34: 939-944). Further, methods which evaluate various regions of the brain and enable the estimation of frequency of senile plaques or neurofibrillary tangle may be used (Braak et al., (1991) Acta Neuropathol 82: 239-259; Khachaturian (1985) Arch Neuro 42: 1097-1105; Mirra et al., (1991) Neurology 41: 479-486; and Mirra et al., (1993) Arch Pathol Lab Med 117: 132-144).

In another embodiment of the present invention, there is provided a kit for γ-secretase assay, or a kit for identifying γ-secretase inhibitors, activators or modulators, each of which comprises EphA4 and, preferably, further comprises a substrate for γ-secretase other than EphA4 (preferably APP and/or Notch). The kit of this embodiment may be used in the screening method of the present invention.

The present invention provides a test kit for measuring the processing of EphA4 by γ-secretase. This kit of the present invention comprises γ-secretase or a biological composition containing γ-secretase, and a biological composition containing EphA4. The kit may further comprise a substrate for γ-secretase other than EphA4 (e.g., APP and/or Notch) or a biological composition containing such a substrate. Preferably, the kit comprises a plurality of substrates for γ-secretase. It is preferred that the kit comprises APP and/or Notch in addition to EphA4. Further, the kit comprises tools used in immunoblotting or Western blotting (e.g., reaction vessels, blotting membranes, etc.), reagents (e.g., buffers, culture broths, anti-EphA4 antibodies, etc.), instructions, and so on. With the assay kit of the present invention, it is possible to evaluate whether or not a candidate compound affects the processing of EphA4 by γ-secretase.

The present invention also includes the use of the above-described kit in measuring the processing of EphA4, or in the method of screening or testing γ-secretase inhibitors.

EXAMPLES

Herein below, the present invention will be described in more detail with reference to the following Examples and Preparation Examples. However, the present invention is not limited to these Examples, which are provided only for the purpose of full disclosure of the present invention to those skilled in the art. It is not meant or even implied that the experiments described herein are all or only one experiment actually carried out. Although efforts have been made to guarantee the accuracy of the numerical values used herein (e.g., volume, temperature, concentration, etc.), experimental errors and deviations are considered to some extent. Thus, such values may be changed within a range which does not depart from the scope of the present invention.

Example 1

Analysis of EphA4 Processing in EphA4-Transfected 294/EBNA-1 Cell Strain

Whether or not EphA4 is a substrate for γ-secretase was evaluated using HEK293 cells expressing EphA4 with an HA tag added to its C-terminus, in the presence of a γ-secretase inhibitor. As the γ-secretase inhibitor, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (hereinafter, sometimes referred to as "Compound E") (Alexis Biochemicals) was used.
1. Experimental Conditions and Methods
(1) Cloning of Rat EphA4

RNA was purified from rat brain with Trisol (Invitrogen), followed by synthesis of 1st strand cDNA with RNA PCR Kit (TaKaRa). Using 1 μl of the finally synthesized 1st strand cDNA product, rat EphA4 was amplified with the following primers and Pfu (Stratagene):

```
primer1 XhoI site added:
                                      (SEQ ID NO:89)
GAGCTCGAGGCCACCATGGCTGGGATTTTCTATTTCATC primer2 NotI site added:
                                      (SEQ ID NO:90)
GAGGCGGCCGCGACAGGAACCATCCTGCCATGCATC
```

PCR conditions were as follows: first reaction at 95° C. for 2 minutes; then 35 cycles of (at 95° C. for 45 seconds→mat 60° C. for 45 seconds→at 72° C. for 6 minutes); then final reaction at 72° C. for 10 minutes. The PCR product was purified with Quiaquick PCR purification kit (QIAGEN, treated with restriction enzymes XhoI (TaKaRa) and NotI (TaKaRa) and then cloned into pBluescript (Stratagene).
(2) Construction of a Gene Encoding Rat EphA4 with HA Tag Added to its C-Terminus and an Expression Vector pcDNA (Invitrogen) was treated with restriction enzymes XhoI (TaKaRa) and NotI (TaKaRa). EphA4 obtained by treating the pBluescript obtained in (1) above with restriction enzymes XhoI (TaKaRa) and NotI (TaKaRa) was inserted into the resultant pcDNA to thereby prepare an expression vector. This expression vector was constructed so that an HA tag is added to the C-terminus of the incorporated EphA4. The DNA sequence of the resultant EphA4-HA was analyzed with a DNA sequencer (Applied Biosystems Model 3130x1). The resultant DNA sequence is shown in SEQ ID NO: 3. In the resultant DNA sequence, the nucleotide at position 861 was changed from c to t, compared with rat EphA4 (XM_244186.4). (Hereinafter, this mutation is expressed as "c→t". Other mutations will also be expressed in the same manner.) Besides, the resultant DNA sequence had a→t mutation at position 1110, a→g mutation at position 1278, a→g mutation at position 1320, c→t mutation at position 1623, c→t mutation at position 1626, c→t mutation at position 2208 and c→t mutation at position 2265, compared with rat EphA4 (XM_244186.4). However, it was confirmed that they were 100% identical at the amino acid level. This expression vector was prepared in large quantity with Endofree Plasmid Maxi Kit (QIAGEN).

The sequence spanning from g at position 2968 to t at position 2997 in the DNA sequence of EphA4-HA (SEQ ID NO: 3) is a nucleotide sequence encoding the HA tag.

The amino acid sequence of EphA4-HA is shown in SEQ ID NO: 4.

(3) Preparation of Cells Expressing a Gene Encoding Rat EphA4 with HA Tag Added to its C-Terminus 293/EBNA-1 cell strain (Invitrogen) was cultured in 10% FBS (Hyclone)/DMEM (Invitrogen) under 5% $CO_2$ at 37° C., followed by transfection thereinto of a gene encoding rat EphA4 with an HA tag added to its C-terminus with Lipofectamine 2000 (Invitrogen). After one day culture under the same conditions, Compound E (γ-secretase inhibitor, Alexis Biochemicals) was added to the medium (final concentration: 50 nM). Cells were cultured for another day under the same conditions. Then, the transfected HEK293 cells were collected with PBS (Sigma) and sonicated with a sonicator (Taitec VP-5S) to disrupt cells. Then, the quantity of protein was determined with Protein Assay Kit (BioRad). Samples (2 μg each) were taken from proteins obtained from Compound E-added cells and Compound E-not added cells, respectively, and subjected to SDS-PAGE, followed by Western blotting with an anti-HA antibody (Roche) (final concentration: 0.2 μg/ml).

2. Experimental Results

Figure 1:
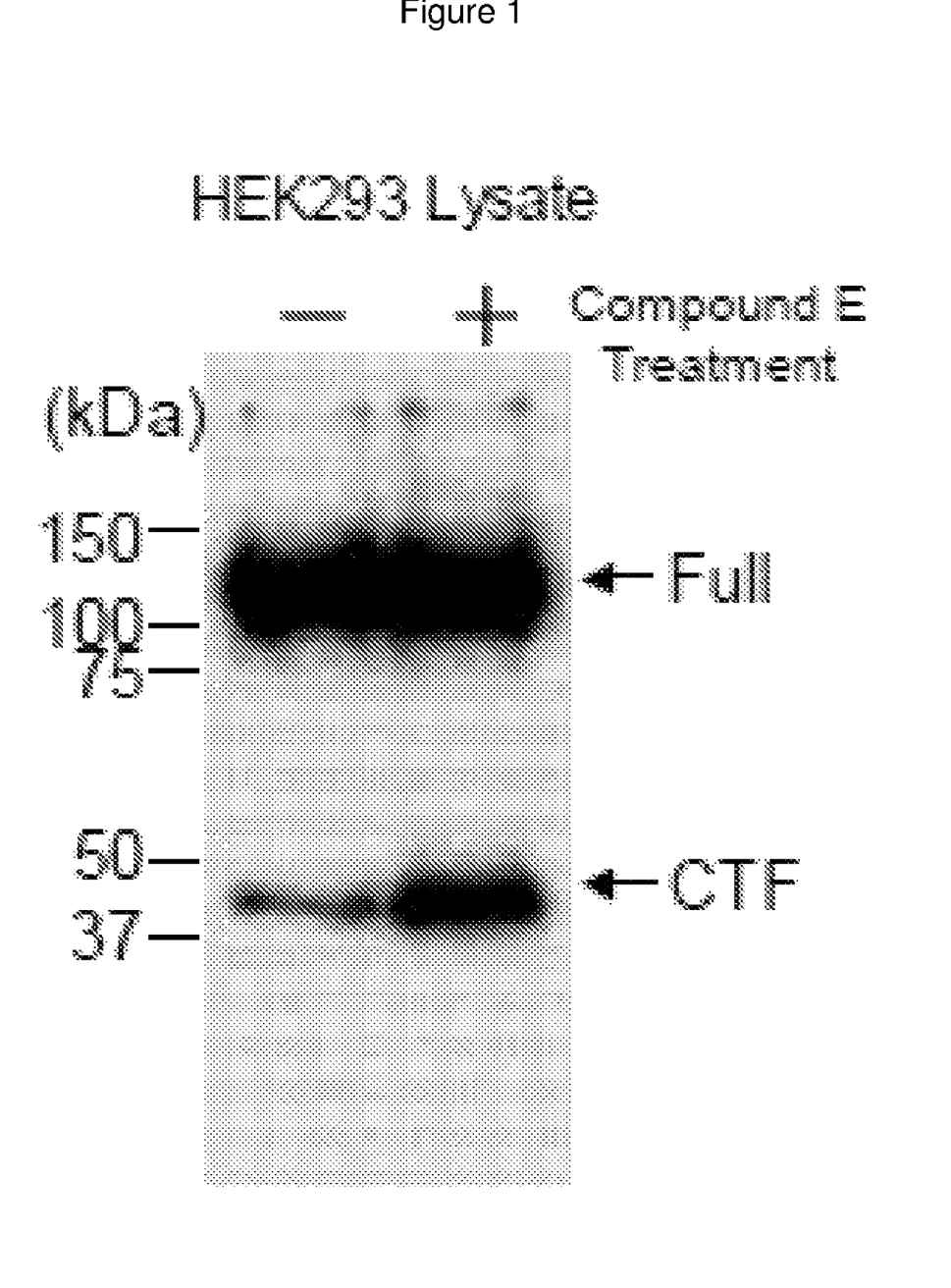
FIG. 1 is a diagram showing the results of analysis of EphA4 processing using EphA4-transfected 293/EBNA-1 cell strain.

FIG. 1 shows the results.

In FIG. 1, the left lane represents the sample untreated with Compound E and the right lane represents the sample treated with Compound E. "Full" represents the full-length of EphA4. "CTF" (C-terminal fragment) represents a region spreading from the transmembrane domain of EphA4 (amino acid residue at position 547) to its C-terminal site; that is, this fragment is EphA4 undegraded product. When Compound E (γ-secretase inhibitor) was added, a band around 50 kDa (CTF) was accumulated specifically. Since this band is equal in size to the region spreading from the transmembrane domain of EphA4 to its C-terminal site, it has become clear that EphA4 is cleaved by γ-secretase in HEK293 cells.

Example 2

Analysis of EphA4 Processing in Primary Culture of Rat Hippocampal Neurons

Whether or not EphA4 is a substrate for γ-secretase was evaluated using a primary culture of rat hippocampal neurons in the presence of a γ-secretase inhibitor. As the γ-secretase inhibitor, (2S)-2-{[(3,5-difluorophenyl)acetyl]amino}-N-[(3S)-1-methyl-2-oxo-5-phenyl-2,3-dihydro-1H-1,4-benzodiazepin-3-yl]propanamide (Compound E) (Alexis Biochemicals) was used.

1. Experimental Conditions and Methods (1) Preparation of Primary Culture of Neurons The hippocampus was isolated from embryonic day 18 SD rats (Charles River) and subjected to culture. Specifically, embryos were removed aseptically from pregnant rats under etherization. The brain was removed from each embryo and dipped in 20% FBS (Hyclone)/HBSS (Sigma). The hippocampus was collected from the thus obtained brain under a stereomicroscope. The collected hippocampus was treated in an enzyme solution containing 0.25% trypsin (Invitrogen) and 0.5 mg/ml DNase (Sigma) at 37° C. for 10 minutes to disperse cells. This enzyme reaction was terminated by adding 20% FBS (Hyclone)/HBSS (Sigma). Then, 2 ml of HBSS (Sigma) was added to the resultant cells. The HBSS-added cell mass was re-dispersed by gentle pipetting. The resultant neuron suspension was diluted with a medium and plated in 10 cm dishes at an initial cell density of $1.5 \times 10^6$ cells/dish. As the medium, MEM medium (Invitrogen) supplemented with 10% FBS (Hyclone), 1× B27 Supplement (Invitrogen, 2 mM L-glutamine (Invitrogen) and 25 μg/ml insulin (Sigma) was used. The plated cells were cultured in an incubator under 5% $CO_2$ and 95% air at 37° C. for 3 days. Then, a half volume of the medium was exchanged with a cytosine β-D-arabinofuranoside hydrochloride (AraC)-containing medium in order to inhibit the growth of glial cells. As the AraC-containing medium, MEM medium (Invitrogen) supplemented with 5% FBS (Hyclone), 1× B27 Supplement (Invitrogen), 0.5 mM L-glutamine (Invitrogen), 25 μg/ml insulin (Sigma) and 8 μM AraC (Sigma) was used. Two weeks after the start of culture, Compound E (final concentration: 50 nM) was added, and the cells were cultured for another week. Then, cells were collected with PBS and subjected to quantitative determination of protein. Protein samples (10 μg each) were subjected to SDS-PAGE and Western blotting with an anti-EphA4 antibody (Upstate)(1/500 dilution).

2. Experimental Results

Figure 2:
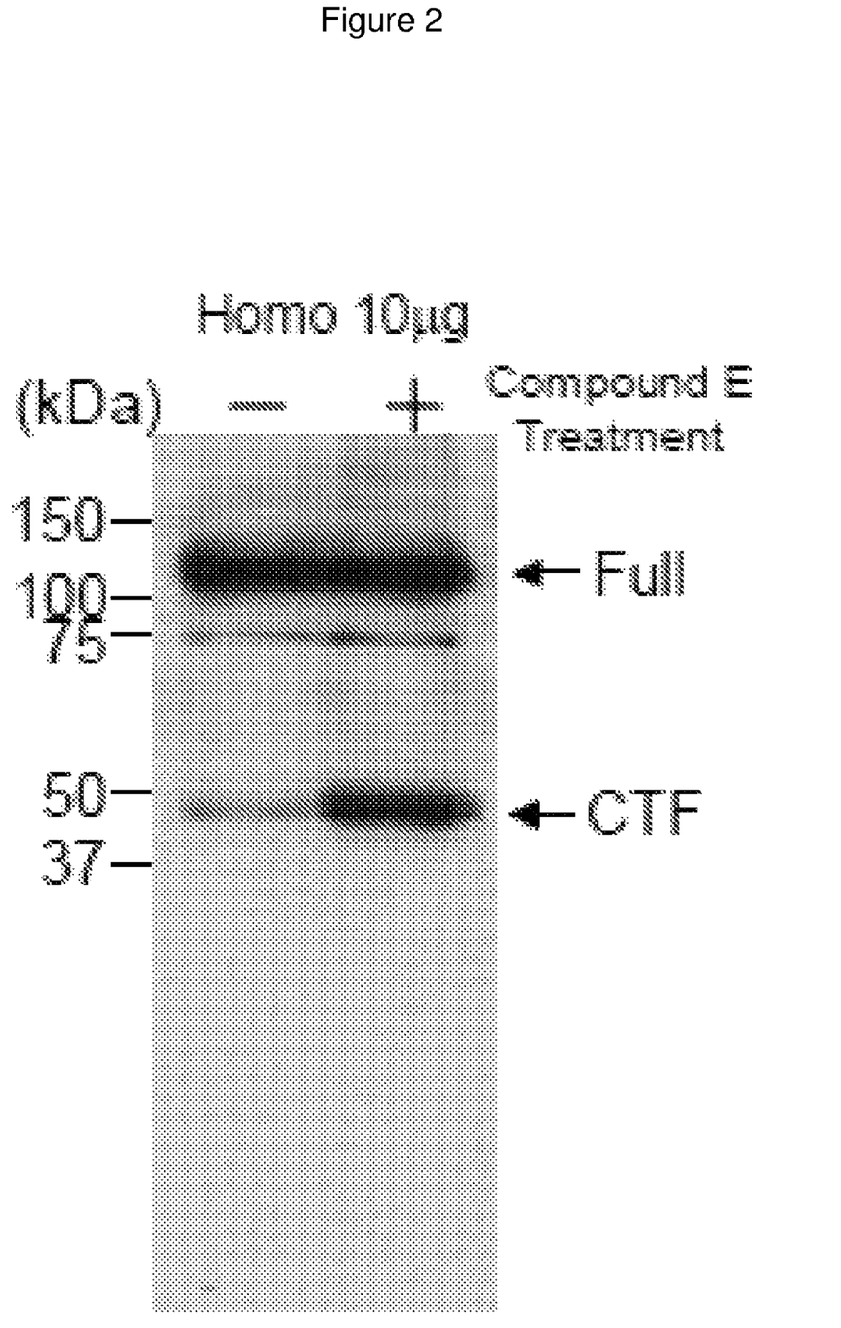
FIG. 2 is a diagram showing the results of analysis of EphA4 processing using primary culture of rat hippocampal neurons.

FIG. 2 shows the results.

In FIG. 2, the left lane represents the sample untreated with Compound E and the right lane represents the sample treated with Compound E. "Full" represents the full-length of EphA4. "CTF" represents a region spanning from the transmembrane domain of EphA4 to its C-terminal site. When Compound E (γ-secretase inhibitor) was added, a band around 50 kDa (CTF) was accumulated specifically. Since this band is equal in size to the region spreading from the transmembrane domain of EphA4 to its C-terminal site, it has become clear that EphA4 is cleaved by γ-secretase in hippocampal neurons.

The technical terms used herein are used only for the purpose of illustrating a specific embodiment and not intended to limit the embodiment.

Unless otherwise specifically defined, all technical terms and scientific terms used herein have the same meaning as generally understood by those skilled in the art. Although any methods and materials similar to or equivalent to those described herein may be used in the practice or test of the present invention, those skilled in the art can consult the description provided herein, for preferable methods and materials.

All publications cited herein are incorporated herein by reference in their entirety for the purpose of describing and disclosing, for example, the cell lines, constructs and methods described in the publications that are used in connection with the present invention, or incorporated herein as references with respect to the disclosure of the compound identification method, screening method and methodologies therefor, and composition of the present invention; such publications may be used for the practice of the present invention.

SEQUENCE LISTING FREE TEXT

SEQ ID NO: 89: synthetic DNA
SEQ ID NO: 90: synthetic DNA

SEQUENCE LISTING (90 sequences)

SEQ ID NO: 1 - DNA, 2961 bp, Rattus norvegicus
  CDS (1)..(2958)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggacgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggagctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccagaccagtcagtgtctgtcacagtgacaaccaaccaagcagcaccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggcgacggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtacttatctgatatgagctatgtgcatcgagacctggctgccaggaacattctggtaaacagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtctga

SEQ ID NO: 2 - protein, 986 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 3 - DNA, 3000 bp, Rattus norvegicus
  CDS (1)..(2997)
atggctgggattttctatttcatcctcttttcgtttctctttggaatttgcgacgctgtcaccggttctagggtatacccggcgaatgaagttactttattggattccagatctgttcagggagagcttgggtggatagcaagccctctggaaggagggtgggaggaagtaagcattatggatgagaaaaatacaccgatccgaacctaccaggtatgcaacgtgatggaagccagtcagaacaactggctgcgaactgactggatcacccgagaaggggcgcagagggtgtacattgaaattaagttcactctgagggactgcaacagtcttccgggcgtcatggggacttgcaaggagacgtttaacctttactactatgaatcggacaacgacaaggagcgcttcatcagagagagccagttcggcaagatcgacaccatcgcagcggatgagagctttacacaggtggacattggggacagaatcatgaagctcaacaccgagatccgggatgtagggcccctgagcaagaagggtttttacctggcttttcaggatgtgggtgcttgcatcgccctggtgtctgttcgtgtgttctacaagaagtgtcccctcaccgttcgaaatctagcccagttccccgataccatcactggggctgatacctcttccctggtggaagttcgaggctcctgtgtcaacaactcagaagagaaggatgtgccaaaaatgtactgtggggcagatggtgaatggctggtacccattggcaactgcctatgcaatgctgggcacgaggagcagaatggtgaatgccaagcttgcaaaattggatattacaaagctctctccacggatgccacctgtgccaagtgtccaccgcacagctactctgtctgggaaggagccacgtcctgcacctgtgaccgaggctttttcagagctgacaacgatgccgcgtccatgccctgcacccgcccaccatctgctcccctcaacttgatttctaatgtcaacgagacgtcggtgaacttggaatggagcagtcctcagaacacaggtggccgtcaggacatttcttacaacgtggtctgcaagaaatgtggtgctggggatcccagcaagtgtcgaccctgtggaagtggagtccactacacgccacagcagaatggactcaagacgaccagagtctccatcactgacctcctagcacacaccaattacacgtttgagatctgggcagtgaatggcgtgtctaagtacaaccctagcccggaccagtcagtgtctgtcacagtgacaaccaaccaagcagcgccatcatccattgctttggtccaggctaaagaagttacaagatacagtgtggctctggcttggctggaaccagatcgaccaaacggagtcatcttagaatatgaagtgaaatattatgaaaaggatcagaatgaacgaagctatcgcatagttcggacagctgccaggaacacagatatcaaaggcctgaaccctttgacttcttacgtcttccacgtgcgagccaggaccgccgctggctatggagacttcagcgaacccttggaagtcactaccaatacagtgccttcccgaatcattggtgatggggccaactctaccgtcctgctggtctccgtctctggcagtgtagtactcgtggtcattctcattgcggcatttgtgatcagccgtagacggagtaagtacagccaagcaaagcaagaagcagatgaagagaagcatttgaatcaaggtgttagaacatacgtggatccctttacatatgaagaccccaaccaggcagttcgagaatttgccaaagaaatcgatgcctcctgcattaaaatcgaaaaggtcattggagttggcgaatttggagaagtctgcagtgggcgtctcaaagtgcccggcaagagagagatctgtgtggccatcaagactctgaaagctggttatactgacaagcagaggagagacttcctgagcgaggccagcatcatgggacagtttgaccacccaaacataatccacctggaaggcgttgtcaccaaatgtaaaccagtaatgatcatcacggagtacatggagaacggctccttggacgctttcctcaggaagaatgatggccgatttacagtcattcagctggtgggcatgctccgaggcattggctcggggatgaagtatttatctgatatgagctatgtgcatcgagacctggctgccaggaacattctggtaaatagcaacttggtctgcaaggtgtctgatttcggcatgtccagggtgcttgaggatgacccggaagcagcctatactaccaggggcggcaagattcccatccggtggactgcaccagaagcaattgcgtatcgtaaatttacctcagccagtgacgtctggagctacggaatcgttatgtgggaagtgatgtcatatggagagaggccgtactgggatatgtccaatcaagatgtgatcaaagccatcgaggaagggtaccggctacccccgccaatggactgccccattgccctccatcagttaatgctggactgttggcagaaagagagaagcgacaggcctaaatttgggcagatcgtcaacatgttggacaaactcatccgcaaccccaacagcctgaagaggacagggccagagagttccagaccaaacacagccttgttagatcccagctcccctgaattctccgccgtagtatcagtgggtgactggctgcaggccatcaaaatggaccggtataaggacaacttcacagccgccgggtacacgacactagaagctgtggttcacatgagccaggatgacctggcgcgaattggcatcaccgcaatcacgcaccagaataagattttgagcagcgtccaggcgatgcgaacccagatgcagcagatgcatggcaggatggttcctgtcgcggccgcagactacccatacgacgtcccagactacgcttag

SEQ ID NO: 4 - protein, 999 aa, Rattus norvegicus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSQAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGPESSRPNTALLDPSSPEFSAVVSVGDWLQAIKMDRYKDNFTAAGYTTLEAVVHMSQDDLARIGITAITHQNKILSSVQAMRTQMQQMHGRMVPVAAADYPYDVPDYA

SEQ ID NO: 5 - DNA, 2961 bp, Homo sapiens
  CDS (1)..(2958)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 6 - protein, 986 aa, Homo sapiens
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 7 - DNA, 2850 bp, Homo sapiens
  CDS (1)..(2847)
atggctgggattttctatttcgccctattttcgtgtctcttcgggatttgcgacgctgtcacaggttccagggtataccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaagatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccatctgctcccctgaacttgatttcaaatgtcaacgagacatctgtgaacttggaatggagtagccctcagaatacaggtggccgccaggacatttcctataatgtggtatgcaagaaatgtggagctggtgaccccagcaagtgccgaccatgtggaagtggggtccactacaccccacagcagaatggcttgaagaccaccaaagtctccatcactgacctcctagctcataccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggttacaaccaacacagtgccttcccggatcattggagatggggctaactccacagtccttctggtctctgtctcgggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagtgcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcgctccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggtcattaaaatggaccggtataaggataacttcacagctgctggttataccacactagaggctgtggtgcacgtgaaccaggagtaa

SEQ ID NO: 8 - protein, 949 aa, Homo sapiens [sequence omitted]

SEQ ID NO: 9 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 10 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 11 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaatgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 12 - protein, 986 aa, Mus musculus; identical to SEQ ID NO: 10

SEQ ID NO: 13 - DNA, 2961 bp, Mus musculus
  CDS (1)..(2958)
atggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagactgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgacaccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaattgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagtgacaggcctaaatttgggcagatcgtcaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 14 - protein, 986 aa, Mus musculus
MAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKTDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 15 - DNA, 2784 bp, Mus musculus
  CDS (1)..(2781)
atggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactattatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggatgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagtcctcagaacacaggtggccgtcaggacatttcttacaacgtggtctgcaagaaatgtggagctggtgatcccagcaaatgccggccctgtggaagtggagtccactacacaccacagcagaacggactcaagacgaccagagtctccatcactgacctcctagcacacaccaattacacgtttgagatctgggcagtgaatgaagtgtctaagtataaccctagcccggaccagtccgtgtctgtcacagtgacaaccaaccaagcagcaccatcatccattgctttggtccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctcttacttcctatgttttccacgtgcgagccaggaccgctgctggctacggagacttcagcgagcccctggaagtcactactaatacagtgccttcccgcatcattggcgatggagccaactccactgtcctgctggtctctgtctctggcagtgtggtcctcgtggtcattctcattgcagcttttgtgatcagccgaagacggagtaagtacagcaaagcgaaacaagaagcagatgaagagaaacatttgaatcaaggtgttagaacttatgtggatccctttacatacgaagaccccaaccaggcagttcgagaatttgccaaagaaatcgatgcatcctgcattaaaattgaaaaggtcataggagttggtgaatttggagaggtctgcagtgggcgtctcaaagtgcccggcaagagagagatctgtgtggccatcaagactctgaaagctggctatactgacaagcagaggagagacttcctgagtgaggccagcatcatgggacagtttgaccacccaaacataatccacctggaaggcgttgtcaccaaatgtaaaccggtaatgatcataacggagtacatggagaacggctccttggatgctttcctcaggaagaatgatggccgctttacagtcattcagctggtgggcatgctccggggcattggctcggggatgaagtacttatctgatatgagctatgtgcatcgagacctggctgccaggaacatcctggtaaacagcaacttggtctgcaaggtgtctgactttggcatgtccagggtgctggaggatgaccccgaagcagcctacactaccaggggtggcaagattcctatccggtggactgcgccagaagcaatcgcgtatcgtaaatttacctcagccagtgatgtctggagctacggaatcgttatgtgggaagtgatgtcatatggagagagaccgtactgggatatgtccaatcaagatgtgatcaaagccatcgaggaagggtaccggctaccccctccaatggactgccccattgccctccatcagttaatgctggactgctggcagaaagagagaagcgacaggcctaaatttgggcagatcgttaacatgctggacaaactcatccgcaatcccaacagcctgaagaggacagggtcggagagttccagaccaaacacagccttgttagatcccagctcccctgaattctctgctgtagtatcagtgggcgactggctgcaggccatcaaaatggaccggtataaggacaacttcacggccgccgggtacacgacactagaagccgtggttcacatgagccaggacgacctggcgagaattggcatcaccgccatcacgcaccagaataagattttgagcagcgtccaggcgatgcgaacccagatgcagcagatgcatggcaggatggttcctgtctga

SEQ ID NO: 16 - protein, 927 aa, Mus musculus
MDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNEVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPNTALLDPSSPEFSAVVSVGDWLQAIKMDRYKDNFTAAGYTTLEAVVHMSQDDLARIGITAITHQNKILSSVQAMRTQMQQMHGRMVPV

SEQ ID NO: 17 - DNA, 1725 bp, Mus musculus
  CDS (1)..(1722)
cgaaccatggctgggattttctatttcatcctcttttcgtttctctttggaatttgcgacgctgtcaccggttctagggtataccccgcgaatgaagttactttattggattccagatctgttcagggagagcttgggtggatagcaagccctctggaaggagggtgggaggaagtgagcattatggatgagaaaaatacaccgatccgaacctaccaggtgtgcaacgtgatggaagccagccagaacaactggctgcgaactgactggatcacccgcgaaggggcgcagagggtgtacattgaaattaagttcactctaagggactgcaacagtcttccgggcgtcatggggacttgcaaggagacgtttaacctctactactatgagtcggacaacgacaaggagcgcttcatcagagagagccagtttggcaagatcgacaccatcgcagctgatgagagcttcacgcaggtggacattggtgaccgaatcatgaaactcaacactgagatccgggatgtagggccactgagcaagaaagggttttacctggcttttcaggatgtgggtgcttgcatcgccctggtgtctgtccgtgtgttctacaagaagtgtccactcaccgttcgaaatctagcccagtttcctgataccattactggggctgatacctcttccctggtggaagttcgaggctcctgtgtcaacaactcagaagagaaggatgtgccaaaaatgtactgtggggcagatggtgaatggctggtacccattggcaactgcctatgcaacgctgggcacgaggagcagaatggtgaatgccaagcttgcaaaattggatattacaaagctctttccacggacgcctcctgtgccaagtgtccaccgcacagctactctgtctgggaaggagccacgtcctgcacctgtgaccgaggctttttcagagctgacaacgatgcagcctccatgccctgcacccgcccaccatctgctcccctcaacttgatttctaatgtcaacgagacatcggtgaacttggaatggagcagccctcagaacacaggtggccgtcaggacatttcttacaacgtggtctgcaagaaatgtggagctggtgatcccagcaagtgccggccctgtggaagtggagtccactacacaccacagcagaacggactcaagacgaccagagtctccatcactgacctcctagcacacaccaattacacgtttgagatctgggcagtgaatggagtgtctaagtataaccctagcccggaccagtccgtgtctgtcacagtgacaaccaaccaagcagcaccatcatccattgctttggcccaggctaaagaagttacaagatatagcgtagctctggcttggctggaaccagatcgaccaaatggagtcatcttagaatatgaagtcaaatattatgaaaaggatcagaatgaacgcagctatcgcatagtccggacagctgccaggaacacagatatcaaaggcctgaaccctctgacttcctatgtttttcacgtgcgagccaggaccgctgctggctacggagacttcagcgagcccctggaagtcactactaatacagtgccttcccgcatcattggcgatggagccaactccactgtcctgctggtctccgtctctggcagtgtggtcctcgtggtcattctcattgcagcttttgtgatcagccgaaggtaa

SEQ ID NO: 18 - protein, 574 aa, Mus musculus
RTMAGIFYFILFSFLFGICDAVTGSRVYPANEVTLLDSRSVQGELGWIASPLEGGWEEVSIMDEKNTPIRTYQVCNVMEASQNNWLRTDWITREGAQRVYIEIKFTLRDCNSLPGVMGTCKETFNLYYYESDNDKERFIRESQFGKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEEQNGECQACKIGYYKALSTDASCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTRVSITDLLAHTNYTFEIWAVNGVSKYNPSPDQSVSVTVTTNQAAPSSIALAQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRR

SEQ ID NO: 19 - DNA, 2961 bp, Monodelphis domestica
  CDS (1)..(2958)
atggctgggattttatatttcattctcttttcgtttctatttgggatttgcaatggtgtcaccggttctaggatatatcccgccaatgaagttactttattggattccagatcggttcagggagaacttgggtggatagccagccctttggaaggagggtgggaagaagtgagcattatggatgagaaaaatactccaatccgtacctaccaagtctgcaatgtgatggagtccagccaaaacaactggttacgaactgattggattcctcgggaaggggctcagagggtgtatatcgagattaaattcacactgagggactgcaatagcctaccaggagttatgggaacttgcaaagagacttttaacttgtactactatgaatccaacaatgataaagaacgctttattagagagagccagtttgccaagatcgacaccattgctgctgatgagagcttcacccaagtggacattggtgacagaatcatgaagttgaacactgagatacgagatgtgggaccattgagtaagaaagggttctatttggcttttcaagatgttggagcttgtattgccctagtatctgttcgggttttctataagaagtgcccattgacagttcgcaatctggctcaatttccagacaccatcactggggctgatacatcctccctagtggaagttcgaggctcttgtgtcaacaactcagaagagaaggatgtgccaaaaatgtattgtggggcagatggtgaatggctggtacccattggcaactgtctatgcaatgctgggcatgaagagagaaatggagaatgccaagcctgcaagattggatactataaggccctttccactgatactgcctgtgccaagtgcccaccccacagctactccgtctgggagggatccacctcctgcacctgtgaccgaggctattttcgagcagaggatgatgcggcttccatgccctgcactcgcccaccatctgctcccctcaacttgatttcgaatgtcaatgaaacatcagtgaacttggagtggagcagtcctgagaacactgggggccgtcaagacatttcctacaacgtagtgtgcaagaagtgtggtgctggagaggtcaaccgatgtggatcctgcggcagtggagtccactatacaccccagcagaatggcctcaagagcaccaaagtctccatcaccgacctcctggcacatactaactatacttttgaaatcttggctgtgaatggagtgtccaagtacaatccgagtcaggaccaatcagtttcagttactgtgacgacaaaccaagcagctccgtcttccatcgctttgatccaggctaaagaaataacgagatacagtgttgcattggcttggctggaacctgatcggccaaatggagtcatcttagagtatgaagtcaaatattatgagaaggatcagaatgaacgcagctataggattgttcgaacagcctccaggaacactgacatcaaaggcttgaatcccttgacttcctatgtattccatgtgagagcccgaacagcagctggctatggagacttcagtgaaccctttgaggtcacaactaacacagtgccttctcgaatcattggagatggaaccaactccacagtccttctggtgtccgtttcgggcagcgtggttctggtggtcatcctcattgcagccttcgtcatcagccggagacggagtaaatacagtaaggcaaagcaggaagcagatgaagagaaacatttgaatcaaggtgtgagaacctatgttgacccttttacatatgaagatcccaaccaagctgttcgagagtttgccaaagaaattgatgcctcctgcattaagatagaaaaagttataggagtgggtgaatttggtgaagtgtgcagtgggcgactcaaagtacctgggaagagagagatctgtgtggctattaagactcttaaagctgggtatacagacaaacagaggagggatttcctaagtgaagccagcatcatgggacagtttgaccacccaaatatcatccacttagaaggcgtagttaccaaatgtaaacctgtaatgatcataaccgagtacatggagaatggctccttggatgcattcctgaggaagaatgatggaagatttacagtgattcagttggttgggatgcttcgtggcattggttctgggatgaaatacctctctgatatgagctatgtgcatagagatctagctgcccggaacatcttggtcaatagcaacttggtctgcaaagtatctgactttggcatgtctcgtgttcttgaagatgatcctgaagcagcttacacaaccaggggtggcaagattcccatccggtggactgcaccagaagcgattgcttatcgtaaattcacatccgcgagtgatgtatggagctatggaattgtgatgtgggaagtgatgtcgtatggagagcggccttactgggatatgtccaaccaggatgttataaaagccattgaagaaggctaccggctacctccaccaatggactgccccatcgctctccaccagctgatgctagactgctggcagaaggaaagaagtgacagacctaaatttggacagattgtcaacatgttggacaaactcattcgcaaccccaacagcttgaagaggacgggtactgagagctccaggcccaatactgctctgttggatcctagctctcccgagttctctgctgtggtatctgtaggtgattggcttcaggccattaaaatggaccggtataaggacaacttcacagctgccggttacaccaccctcgaggctgtggtgcacatgaaccaggacgacctggcgagaatcggtatcacggccgtcacgcaccagaataagatcttgaacagcgtccaggcaatgcggacccaaatgcaacagatgcatggcaggatggttcctgtctga

SEQ ID NO: 20 - protein, 986 aa, Monodelphis domestica
MAGILYFILFSFLFGICNGVTGSRIYPANEVTLLDSRSVQGELGWIASPLEGGWEEVSIMDEKNTPIRTYQVCNVMESSQNNWLRTDWIPREGAQRVYIEIKFTLRDCNSLPGVMGTCKETFNLYYYESNNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDTACAKCPPHSYSVWEGSTSCTCDRGYFRAEDDAASMPCTRPPSAPLNLISNVNETSVNLEWSSPENTGGRQDISYNVVCKKCGAGEVNRCGSCGSGVHYTPQQNGLKSTKVSITDLLAHTNYTFEILAVNGVSKYNPSQDQSVSVTVTTNQAAPSSIALIQAKEITRYSVALAWLEPDRPNGVILEYEVKYYEKDQNERSYRIVRTASRNTDIKGLNPLTSYVFHVRARTAAGYGDFSEPFEVTTNTVPSRIIGDGTNSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQDDLARIGITAVTHQNKILNSVQAMRTQMQQMHGRMVPV

SEQ ID NO: 21 - DNA, 3084 bp, Canis lupus familiaris
  CDS (1)..(3081)
atgggaaagatcggaaagtcatccatcatgcccgtgacatacatcacacccaacaacagcccaaagccacgagatgtcacgcccgcgggacagattcactcggtgacaggcagtgacagtcagagcccaacaaggatgccagtgccaccagatgttgccgaagctcataaactgggtcagcacaaccacgctgttgcaagaggttccgaacaaataaccttattggattccagatctgttcagggagaacttgggtggatagcgagccctctggaaggagggtgggaggaagtgagtatcatggatgaaaaaaacacaccaatccgaacctaccaagtgtgcaacgtgatggaacccagccagaataactggctccgaactgattggatcacccgagaaggggcgcagagggtgtacattgaaatcaagttcacattgagagactgcaacagccttccaggtgtcatgggcacttgcaaggagacgttcaacctctactactatgaatcagacaacgacaaagagcgttttatccgagagagccagtttgccaagattgacaccatcgctgctgacgagagcttcacccaggtggacattggtgacaggatcatgaagctgaacaccgagatccgggatgtagggccgttgagcaaaaaggggttttatctggcttttcaggatgtgggggcttgcatcgccctggtgtcagtccgtgtgttctataagaagtgtccgctcaccgtccgcaatctggcccagtttccagacaccatcacgggggctgatacgtcttccctggtggaggttcgaggctcctgtgtcaacaactcagaagagaaggatgtgccaaaaatgtactgtggggcagatggtgaatggctggtacccattggcaactgcctatgcaatgctgggcacgaagagcgaaatggagaatgccaagcctgcaaaattgggtattacaaggccctctccacggatgcggcctgtgccaagtgcccgccccacagctattcggtctgggaaggagccacatcgtgtacctgtgaccgaggctttttcagagccgacaacgacgccgcctccatgccctgcacccgcccaccgtctgctcccctcaacctgatttcaaatgtcaacgagacttcggtgaatttggaatggagcagtccccagaacacaggtggccgccaggatatttcctacaatgtggtgtgcaagaaatgtggagctggtgattccagcaagtgccgaccctgtggaagtggggtccactataccccacagcagaatggcctgaagaccaccaaagtttccatcactgacctcctggctcacaccaattacaccttcgaaatctgggcggtgaatggagtgtccaagtacaaccccagcccagaccaatcagtgtccgtcactgtgacgaccaaccaagcagcaccatcatccattgccttggtccaggcgaaagaagttacaagatacagtgttgctctggcttggctggaaccagatcggcccaatggggtgatcttggagtatgaagtcaagtattatgagaaggatcagaatgagcgaagctaccggattgtccggacggccgccaggaacacagatatcaaaggcctgaatcctctgacttcctacgtgttccatgtccgagccaggacagcagctggctacggcgacttcagcgagcccctggaggtcacaaccaacacagtgccttcccggatcatcggagatggggccaactccacggtccttctggtctcagtctcaggcagtgtggtgctggtggtcattctcatcgcggcctttgtcatcagcaggagacggagtaaatacagtaaagctaaacaagaagcagatgaagagaaacatttgaatcaaggtgttagaacttatgtggatccctttacatatgaagatcccaaccaagcagttcgagaatttgccaaagaaatcgacgcctcctgcattaagattgaaaaagtcataggagttggtgaatttggcgaagtatgcagcgggcgtctcaaagtgcctggcaagagagagatctgtgtagccatcaagacactgaaagctggttatacagacaaacagaggagagacttcctgagtgaggccagcatcatgggacagtttgaccacccgaacataattcacttggaaggcgttgtcaccaaatgtaaaccagtaatgatcataacagagtacatggagaatggctccttggatgcattcctcaggaagaatgatggcagatttactgtcattcagctggtgggcatgcttcgtggcatcgggtctgggatgaagtacttatctgatatgagctatgtgcatcgagatctagctgcacggaacattctggtcaatagcaacttggtctgcaaagtgtctgattttggcatgtcgcgagtgcttgaggatgatccggaagcagcttacaccaccaggggtggcaagattcctatccggtggaccgcgccagaagcaattgcctatcgtaaattcacatcagcgagtgatgtatggagctatggaatcgttatgtgggaagtgatgtcgtatggagagagaccctattgggatatgtccaatcaagacgtgattaaagccattgaggaaggctatcggctcccccctccaatggactgccccatcgccctccatcagctgatgctagactgctggcagaaggagagaagtgacaggccgaaattcgggcagattgtcaacatgttggacaaactcatccgcaaccccaacagcttgaagaggacgggaactgagagctccagacctaacactgccttgttggacccaagctcccctgaattctccgccgtggtatcagtgggcgattggctccaggccattaaaatggaccgatataaggataacttcacggctgctggttataccacactagaggctgtagtgcacatgaaccaggaggacctggcgaggatcggcatcacggccgtcacacaccagaacaagattttgagcagcgtccaggcgatgagaacccaaatgcaacagatccacggcaggatggttcccgtctga

SEQ ID NO: 22 - protein, 1027 aa, Canis lupus familiaris
MGKIGKSSIMPVTYITPNNSPKPRDVTPAGQIHSVTGSDSQSPTRMPVPPDVAEAHKLGQHNHAVARGSEQITLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRESQFAKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERNGECQACKIGYYKALSTDAACAKCPPHSYSVWEGATSCTCDRGFFRADNDAASMPCTRPPSAPLNLISNVNETSVNLEWSSPQNTGGRQDISYNVVCKKCGAGDSSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHMNQEDLARIGITAVTHQNKILSSVQAMRTQMQQIHGRMVPV

SEQ ID NO: 23 - DNA, 2961 bp, Pan troglodytes
  CDS (1)..(2958)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 24 - protein, 986 aa, Pan troglodytes; identical to SEQ ID NO: 6

SEQ ID NO: 25 - DNA, 2964 bp, Pan troglodytes
  CDS (1)..(2961)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 26 - protein, 987 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 27 - DNA, 2784 bp, Pan troglodytes
  CDS (1)..(2781)
atggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 28 - protein, 927 aa, Pan troglodytes [sequence omitted]

SEQ ID NO: 29 - DNA, 2907 bp, Pan troglodytes
  CDS (1)..(2904)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggctaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggacagtgtccaggcaatgcgaacccaaatgcagcagatgcacggcagaatggttcccgtctga

SEQ ID NO: 30 - protein, 968 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 31 - DNA, 3015 bp, Pan troglodytes
  CDS (1)..(3012)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacaggtaacaaggaccacccagactcagtcacttctgagctaatttttgtatgtttagctgtagtcactggggtctctgttttgctaagttggttcctgctttgcaaacaacggagtaaatacagtaaagccaaacaagaagcggatgaagagaaacatttgaatcaagctccgcctccctggttcacaccattctcccacctcagcctcctgagtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccaggcaagtggtgactcacttaaattcctgccttttcatcagaggccacttcatggctctctgcaacctgggtgtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 32 - protein, 1004 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTGNKDHPDSVTSELIFVCLAVVTGVSVLLSWFLLCKQRSKYSKAKQEADEEKHLNQAPPPWFTPFSHLSLLSVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRQVVTHLNSCLFIRGHFMALCNLGVGDWLQAIKMDRYKDNFTAAGYTTLEAVVHVNQEDLARIGITAITHQNKILSSVQAMRTQMQQMHGRMVPV

SEQ ID NO: 33 - DNA, 2958 bp, Pan troglodytes
  CDS (1)..(2955)
atggctgggattttctatttcgccctattttcgtgtctcttcgggatttgcgacgctgtcacaggttccagggtgtaccccgcgaatgaagttaccttattggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtgtatattgagattaaattcaccttgagggactgcaatagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcctgacaccatcacaggggctgatacgtcttccctggtggaagttcgaggctcctgtgtcaacaactcagaagagaaggatgtgccaaaaatgtactgtggggcagatggtgaatggctggtacccattggcaactgcctatgcaacgctgggcatgaggagcggagcggagaatgccaagctagaccttgcaaaattggatattacaaggctctctccacggatgccacctgtgccaagtgcccaccccacagctactctgtctgggaaggagccacctcgtgcacctgtgaccgaggctttttcagagctgacaacgatgctgcctctatgccctgcacccgtccaccgtctgctcccctgaacttgatttcaaatgtcaatgagacatctgtgaacttggaatggagtagccctcagaatacaggtggccgccaggacatttcctataatgtggtatgcaagaaatgtggagctggtgaccccagcaagtgccgaccctgtggaagtggggtccactacaccccgcagcagaatggcttgaagaccaccaaagtctccatcactgacctcctagctcacaccaattacacctttgaaatctgggctgtgaatggagtgtccaaatataaccctaacccagaccaatcagtttctgtcactgtgaccaccaaccaagcagcaccatcatccattgctttggtccaggctaaagaagtcacaagatacagtgtggcactggcttggctggaaccagatcggcccaatggggtaatcctggaatatgaagtcaagtattatgagaagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaagagggaagtagcttgcagcggctcatgcacactcagccaattcttctcctcacgccggttgtctgctctgttatctcggactataaatgtttaaatgggacaagaacaggtgaacagagaggagacaggtatattcagccaacttatcatgtttatcactcaggtgtaagaacatatgtggacccctttacgtacgaagatcccaaccaagcagttcgagagtttgccaaagaaattgacgcatcctgcattaagattgaaaaagttataggagttggtgaatttggtgaggtatgcagtgggcgtctcaaagtgcctggcaagagagagatctgtgtggctatcaagactctgaaagctggttatacagacaaacagaggagagacttcctgagtgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacaccaccaggttgggtggcaagattcctatccggtggactgcgccagaagcaattgcctatcgtaaattcacatcagcaagtgatgtatggagctatggaatcgttatgtgggaagtgatgtcgtacggggagaggccctattgggatatgtccaatcaagatgtgattaaagccattgaggaaggctatcggttaccccctccaatggactgccccattgcactccaccagctgatgctagactgctggcagaaggagaggagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgctggttataccacactagaggctgtggtgcacgtgaaccaggaggacctggcaagaattggtatcacagccatcacgcaccagaataagattttgagcagtgtccaggcaatgcgaacccaaatgcagcagatgcacggcagaatggttcccgtctga

SEQ ID NO: 34 - protein, 985 aa, Pan troglodytes
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQARPCKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPNPDQSVSVTVTTNQAAPSSIALVQAKEVTRYSVALAWLEPDRPNGVILEYEVKYYEKNERSYRIVRTAARNTDIKGLNPLTSYVFHVRARTAAGYGDFSEPLEVTTNTEEGSSLQRLMHTQPILLLTPVVCSVISDYKCLNGTRTGEQRGDRYIQPTYHVYHSGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRLGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 35 - DNA, 2961 bp, Macaca mulatta
  CDS (1)..(2958)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 36 - protein, 986 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 37 - DNA, 2907 bp, Macaca mulatta
  CDS (1)..(2904)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggacagcgtccaggcaatgcgaacccaaatgcagcagatgcacggcagaatggttcctgtctga

SEQ ID NO: 38 - protein, 968 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQDSVQAMRTQMQQMHGRMVPV

SEQ ID NO: 39 - DNA, 2925 bp, Macaca mulatta
  CDS (1)..(2922)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtccccacagggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 40 - protein, 974 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSPQGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 41 - DNA, 2979 bp, Macaca mulatta
  CDS (1)..(2976)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttgtcatcagccggagacggagtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 42 - protein, 992 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFVISRRRSKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 43 - DNA, 3036 bp, Macaca mulatta
  CDS (1)..(3033)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagtgccttcccggatcattggagatggggccaactccacagtccttctggtctctgtctcaggcagtgtggtgctggtggtaattctcattgcagcttttttttcctgctgccattcaggtgatcagcctctgatgtcattagctgtcgtcactggagtctctgttttgctaagttgtaaatacagtaaagccaaacaagaagcggatgaagagaaacatttgaatcaaggtcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 44 - protein, 1011 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTVPSRIIGDGANSTVLLVSVSGSVVLVVILIAAFFSCCHSGDQPLMSLAVVTGVSVLLSCKYSKAKQEADEEKHLNQGHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 45 - DNA, 2970 bp, Macaca mulatta
  CDS (1)..(2967)
atggctgggattttctatttcgccctcttttcgtgtctcttcgggatttgcgacgctgtcaccggttccagggtgtaccccgcgaatgaagttaccttactggattccagatctgttcagggagaacttgggtggatagcaagccctctggaaggagggtgggaggaagtgagtatcatggatgaaaaaaatacaccaatccgaacctaccaagtgtgcaatgtgatggaacccagccagaataactggctacgaactgattggatcacccgagaaggggctcagagggtatatattgagattaaattcaccttgagggactgcaacagtcttccgggcgtcatggggacttgcaaggagacgtttaacctgtactactatgaatcagacaacgacaaagagcgtttcatcagagagaaccagtttgtcaaaattgacaccattgctgctgatgagagcttcacccaagtggacattggtgacagaatcatgaagctgaacaccgagatccgggatgtagggccattaagcaaaaaggggttttacctggcttttcaggatgtgggggcctgcatcgccctggtatcagtccgtgtgttctataaaaagtgtccactcacagtccgcaatctggcccagtttcccgacaccatcacaggggctgatacgtcttccctggtggaagttcgaggctcctgtgtcaacaactcagaagagaaggatgtgccaaaaatgtactgtggggcagatggtgaatggctggtacccattggcaactgtctatgcaacgctgggcatgaggagcggagcggagaatgccaagcttgcaaaattggatattacaaggctctctccacggatgccacctgtgccaagtgcccaccccacagctactctgtctgggaaggagccacctcgtgcacctgtgaccgaggctttttcagagctgacaatgatgctgcctccatgccctgcacccgtccaccatctgctcccctgaacttgatttcgaatgtcaacgagacatctgtgaacttggaatggagtagccctcagaatacaggtggccgccaggacatttcctacaatgtggtatgcaagaaatgtggagctggtgaccccagcaagtgccgaccctgtggaagtggggtccactataccccacagcagaatggcttgaagaccaccaaagtctccatcaccgacctcctagctcataccaattacacctttgaaatctgggctgtgaatggagtgtccaaatataaccctagcccagaccaatcagtttccgtcactgtgacaaccaaccaagcagcaccatcatccattgctttggtccaggctaaagaagtcacaagatacagtgtggcactggcttggttggaaccagatcggcccaatggtgtaatcctggaatacgaagtcaagtattatgagaaggatcagaatgagcgaagctatcgtatagttcggacagctgccaggaacacagatatcaaaggcctgaaccctctcacttcctatgttttccacgtgcgagccaggacagcagctggctatggagacttcagtgagcccttggaggtcacaaccaacacagaatcatttaaatcaaatggggccaactccacagtccttctggtctctgtctcaggcagtgtggtgctggtggtaattctcattgcagcttttgtcatcagccggagctgccagtatagaacaacacattctgtacaggcatctattttacattgtccaacttatcatgtttattacttaggtgtgagaacatatgtggacccctttacgtacgaagatcccaaccaagcagttcgagaatttgccaaagaaattgacgcatcctgcattaagattgaaaaagttataggagttggtgaatttggtgaggtatgcagcgggcgtctcaaagtgcctggcaagagagagatctgtgtggctatcaagacgctgaaagctggttatacagacaaacagaggagagacttcctgagcgaggccagcatcatgggacagtttgaccatccgaacatcattcacttggaaggcgtggtcactaaatgtaaaccagtaatgatcataacagagtacatggagaatggctccttggatgcattcctcaggaaaaatgatggcagatttacagtcattcagctggtgggcatgcttcgtggcattgggtctgggatgaagtatttatctgatatgagctatgtgcatcgtgatctggccgcacggaacatcctggtgaacagcaacttggtctgcaaagtgtctgattttggcatgtcccgagtgcttgaggatgatccggaagcagcttacactaccaggggtggcaagattcctatccggtggactgcgccagaagcaattgcctatcgtaaattcacatcagcaagtgatgtatggagctatggaatcgttatgtgggaagtgatgtcgtacggggagaggccctactgggatatgtccaatcaagatgtgattaaagccattgaggaaggctatcggttaccccctccaatggactgccccattgcactccaccagctgatgctagactgctggcagaaggagagaagcgacaggcctaaatttgggcagattgtcaacatgttggacaaactcatccgcaaccccaacagcttgaagaggacagggacggagagctccagacctaacactgccttgttggatccaagctcccctgaattctctgctgtggtatcagtgggcgattggctccaggccattaaaatggaccggtataaggataacttcacagctgccggttataccacactagaggctgtggtgcacgtgaaccaggaggacctggcaagaattggtatcacagccatcacgcaccagaataagattttgagcagcgtccaggcaatgcgaacccaaatgcagcagatgcacggcagaatggttcctgtctga

SEQ ID NO: 46 - protein, 989 aa, Macaca mulatta
MAGIFYFALFSCLFGICDAVTGSRVYPANEVTLLDSRSVQGELGWIASPLEGGWEEVSIMDEKNTPIRTYQVCNVMEPSQNNWLRTDWITREGAQRVYIEIKFTLRDCNSLPGVMGTCKETFNLYYYESDNDKERFIRENQFVKIDTIAADESFTQVDIGDRIMKLNTEIRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGHEERSGECQACKIGYYKALSTDATCAKCPPHSYSVWEGATSCTCDRGFFRADNDAASMPCTRPPSAPLNLISNVNETSVNLEWSSPQNTGGRQDISYNVVCKKCGAGDPSKCRPCGSGVHYTPQQNGLKTTKVSITDLLAHTNYTFEIWAVNGVSKYNPSPDQSVSVTVTTNQAAPSSIALVQAKEVTRYSVALAWLEPDRPNGVILEYEVKYYEKDQNERSYRIVRTAARNTDIKGLNPLTSYVFHVRARTAAGYGDFSEPLEVTTNTESFKSNGANSTVLLVSVSGSVVLVVILIAAFVISRSCQYRTTHSVQASILHCPTYHVYYLGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGTESSRPNTALLDPSSPEFSAVVSVGDWLQAIKMDRYKDNFTAAGYTTLEAVVHVNQEDLARIGITAITHQNKILSSVQAMRTQMQQMHGRMVPV

SEQ ID NO: 47 - DNA, 2961 bp, Gallus gallus
  CDS (1)..(2958)
atggccggggtccccgtcggcgcgctcctcccgctcctcgtcggcgtctgcggggccgtcaccggctcccgcgtgtaccccgccaacgaagtgaccctgctggactcccgctcggtgcagggggagctgggctggatcgcgagcccgctggaaggagggtgggaggaagtgagcataatggatgagaagaacactccgatccgcacctaccaagtttgcaatgtgatggagcccagtcagaataattggttacgaactgattggattccccgcgagggggctcagagggtatatattgaaatcaagttcacgctgagagactgcaacagcctgccaggtgtcatgggaacttgcaaagagactttcaacctctattactatgaatcaaacaacgacaaggagcgttttattcgagagagccagtttgccaagattgacaccattgctgctgatgagagcttcacccaggtggacattggtgacaggatcatgaagctgaatacagaggtgcgggacgtggggcctctcagcaagaaagggttttacttggctttccaggacgtcggtgcctgcattgctttggtgtctgttcgtgtcttctataagaagtgcccactgacagttcgaaacctggcacagtttccagacaccattactggggctgatacatcctctctggtggaggttcgtggctcctgtgtcaacaactcggaagagaaggacgtgccaaaaatgtactgcggggcagatggtgaatggctggtacccattggcaactgtctgtgcaatgctggctatgaagaacgcaatggtgaatgccaagcttgcaaaatcggatactacaaggcgctctcaacagatgttgcatgtgccaaatgcccgcctcacagctactccatctgggaaggctctacctcctgcacctgtgatcggggcttcttccgagcagaaaatgatgctgcatccatgccctgcactcgccctccatccgcaccccagaacctgatttccaacgtcaacgagacgtcagtgaacttggagtggagcgccccacagaacaagggaggacgggacgacatctcctacaacgtggtgtgcaagcgctgcggggcaggggagcccagccactgccggtcctgtggcagtggtgtacatttcagcccccagcagaacgggctgaaaaccacgaaggtttccatcactgacctcctggcacacaccaactacacctttgaggtctgggcagtgaatggagtgtccaagcacaaccccagccaggaccaagctgtgtcagtcactgtgacaactaaccaagcagctccatccccaattgcattgatccaggctaaagagataacgaggcacagcgttgccttggcctggctggaacctgacaggcccaatggagtcatcctggagtatgaagtcaagtactatgaaaaggaccaaaacgagcgcagctatcgcattgtgaagacagcctccaggaatactgacatcaaaggtttgaaccccctgacttcatatgtatttcatgtgcgggccaggacagcagcaggatacggagacttcagtgggccgtttgagttcacaactaacacagttccttcccccatcattggcgatggtaccaatcccacagtgctgcttgtttcagtggctggcagtgttgttctcgtggtcattctcattgcagcctttgtcatcagcaggaggcgcagcaaatacagtaaagctaagcaagaggcagatgaggagaaacatttgaaccaaggtgtcagaacatatgtggatccttttacatatgaggatccaaatcaagctgtgagggaatttgccaaagaaattgatgcctcctgcataaagattgagaaagttattggtgtgggggaatttggtgaagtatgcagtggacgtctcaaagttccaggaaaaagagaaatctgtgtggctatcaagactctgaaagctggttacactgacaaacaacggagagacttcctgagtgaggccagcatcatgggacaatttgaccaccccaatatcatccacttggaaggcgttgttactaaatgtaaaccagtaatgatcataactgagtacatggagaatggctccttggatgccttcctccggaagaatgatggcagatttacagtaatccagttggtggggatgcttcgtggcatcggctcaggaatgaagtatctgtctgacatgagctatgtgcatcgggatctagctgctcgaaacatactggtcaacagcaacttggtctgcaaagtgtctgacttcggcatgtcccgtgtcctggaagatgaccctgaggcagcttataccacacggggtggcaagatccctatccgatggactgcaccagaggcaattgcctaccgtaaatttacatcggctagtgacgtgtggagctatggcatcgtcatgtgggaagtgatgtcctatggagagagaccttactgggatatgtccaatcaagacgttattaaagccattgaggaagggtatcggttgccacccccaatggactgccccattgctctccatcagctgatgttagactgctggcagaaggaacgcagcgacagacctaaatttggacagattgtcaacatgctggacaaactcatccgcaaccctaacagcctgaagaggacaggcagcgagagctccagacccagcacagccctgctggatcccagctccccggagttctcggcggttgtttctgtcagtgactggctccaagccattaaaatggagcgatacaaggataacttcacagctgctggctataccaccctagaggctgtggtgcatatgaaccaggacgacctggccaggatcgggatcactgccatcacacaccagaacaagatcttgagcagcgttcaagccatgcgcagccaaatgcaacagatgcacggcaggatggtgcccgtctga

SEQ ID NO: 48 - protein, 986 aa, Gallus gallus
MAGVPVGALLPLLVGVCGAVTGSRVYPANEVTLLDSRSVQGELGWIASPLEGGWEEVSIMDEKNTPIRTYQVCNVMEPSQNNWLRTDWIPREGAQRVYIEIKFTLRDCNSLPGVMGTCKETFNLYYYESNNDKERFIRESQFAKIDTIAADESFTQVDIGDRIMKLNTEVRDVGPLSKKGFYLAFQDVGACIALVSVRVFYKKCPLTVRNLAQFPDTITGADTSSLVEVRGSCVNNSEEKDVPKMYCGADGEWLVPIGNCLCNAGYEERNGECQACKIGYYKALSTDVACAKCPPHSYSIWEGSTSCTCDRGFFRAENDAASMPCTRPPSAPQNLISNVNETSVNLEWSAPQNKGGRDDISYNVVCKRCGAGEPSHCRSCGSGVHFSPQQNGLKTTKVSITDLLAHTNYTFEVWAVNGVSKHNPSQDQAVSVTVTTNQAAPSPIALIQAKEITRHSVALAWLEPDRPNGVILEYEVKYYEKDQNERSYRIVKTASRNTDIKGLNPLTSYVFHVRARTAAGYGDFSGPFEFTTNTVPSPIIGDGTNPTVLLVSVAGSVVLVVILIAAFVISRRRSKYSKAKQEADEEKHLNQGVRTYVDPFTYEDPNQAVREFAKEIDASCIKIEKVIGVGEFGEVCSGRLKVPGKREICVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVNMLDKLIRNPNSLKRTGSESSRPSTALLDPSSPEFSAVVSVSDWLQAIKMERYKDNFTAAGYTTLEAVVHMNQDDLARIGITAITHQNKILSSVQAMRSQMQQMHGRMVPV

SEQ ID NO: 49 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggaccagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaaccaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactgcatcagctcatgttggactgctggcagaaggatcgtagtgaccgaccaaaatttgggcagatagtcagcatgctggataaactcatcaggaacccaaacagtttgaaaaggactgggctggagaattcaagcagaacaaatacggctctgctggaccccagttcgcctgaatggtcccaggtggcttctgtgcttgattggctgcaggccatcaaaatggaaagatacaaagataacttcacagcagccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcaggatggttcctgtttga

SEQ ID NO: 50 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSSRTNTALLDPSSPEWSQVASVLDWLQAIKMERYKDNFTAAGYTSLEAVVHVNQDDLTRIGISSPSHQNKILSSVQGMRTQLQQMQGRMVPV

SEQ ID NO: 51 - DNA, 2958 bp, Xenopus laevis
  CDS (1)..(2955)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgttcgccttgtggcagtggagtgcactatagcccccagcaaaatggcctgaagactaccaaagtgtccattaatgacctgcaagcccatactaactacacctttgaggtctgggccattaatggtgtctccaagcagaaccctgaacaagatcaggctgtgtcagttactgtgaccaccaaccaagctgctccttcaactgtaacccagatacagccaaaagagatcaccaggcacagtgtgtctttgacttggccagagcctgagcgagccaatggggtcatcctggaatacgaagtcaagtattatgagaaggatcagaatgagcgtagttatcgaattgttaagacggcctcgcgaagtgcagacatcaaaggtctcaacccccttactggttatgtgttccatgttcgtgctcggacagctgcaggatatggggagttcagtggaccctttgagttcaccacgaatacagtgccatccccgatgattggcgaaggaaccagccccactgtgcttttggtgtccgtggctggaagcattgtccttgtggtcattctcattgctgcttttgtcatcagcagaagacggagtaaatacagtaaagccaagcaggaagcagacgaggaaaaacatttaaaccaaggagtaaagacttatgtggacccatttacatatgaagatcctaaccaggctgtccgcgaatttgcaaaggaaatcgatgcctcttgtattaagatcgaaaaagtaattggagtaggtgaatttggtgaagtgtgcagtgggcgtctgaaggtccctggaaagagagagatttatgttgcaattaagaccctgaaagctggttacaccgataagcagaggagagactttctcagtgaggccagcatcatgggtcagtttgaccatcctaacatcatccaccttgaaggtgttgtcaccaaatgcaagccagtgatgataatcaccgagtacatggagaacggatccttggatgcattccttcggaagaatgatggtcggtttacagtaatacagcttgtgggaatgctgcgtggcattgggtctggaatgaaatacctttcggacatgagttatgtgcaccgggacctagctgctcgtaatatccttgtgaacagcaacctagtctgtaaggtctctgactttggcatgtctcgggtgctggaagatgaccctgaagcagcctacacaacaaggggtggcaagatcccaatccgatggactgcaccagaagctattgcatacaggaaattcacttctgctagtgatgtctggagctatggcattgtcatgtgggaagtcatgtcttatggagagaggccttactgggatatgtccaatcaagatgtaattaaagcaatcgaggaaggatacaggctgcccccgcctatggactgccctattgcactacatcagctcatgttggactgctggcagaaggatcgtagtgaccgaccaaaatttgggcagatagtcagcatgctggataaactcatcaggaacccaaacagtttgaaaaggactgggctggagaattcaagaacaaacacggctctgctggaccccagttcgcctgaatggtcccaggtggcttctgtgcttgattggctgcaggcatcaaaatggaaaagatacaaagataacttcacagcggccggatacaccagcttggaagcagtcgtgcatgtgaatcaagatgacttgaccaggattggcattagttccccttcacaccagaacaagatcctgagcagcgtccaaggaatgaggacccagttgcagcaaatgcaaggcagaatggttcctgtttga

SEQ ID NO: 52 - protein, 985 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCSPCGSGVHYSPQQNGLKTTKVSINDLQAHTNYTFEVWAINGVSKQNPEQDQAVSVTVTTNQAAPSTVTQIQPKEITRHSVSLTWPEPERANGVILEYEVKYYEKDQNERSYRIVKTASRSADIKGLNPLTGYVFHVRARTAAGYGEFSGPFEFTTNTVPSPMIGEGTSPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGMLRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKDRSDRPKFGQIVSMLDKLIRNPNSLKRTGLENSRTNTALLDPSSPEWSQVASVLDWLQASKWKRYKDNFTAAGYTSLEAVVHVNQDDLTRIGISSPSHQNKILSSVQGMRTQLQQMQGRMVPV

SEQ ID NO: 53 - DNA, 2961 bp, Xenopus laevis
  CDS (1)..(2958)
atggctgggattgtacatggcatcttgttttgtggcctctttggactttgttgggcagtgacgggatctaggatttacccagccagtgaagttaccctgctggattccaggtcagtgcaaggagagcttggctggatagcaagtcctttggaaggagggtgggaagaagtgagtatcatggatgaaaagaatacacctatacgaacttaccaagtctgcaatgtcatggaatcgagccaaaacaactggttacggactgactggattccccgaagtggagctcagagagtatatgttgaaattaaatttacattaagggactgcaacagcttgcctggggtaatgggtacctgcaaagagacctttaatctgtattattatgagtccaacaatgacaaagagcgtttcattcgtgaaacccagtatgtgaaaatcgataccattgcagccgatgagagcttcacccaggttgatattggggaccgtattatgaagctgaacactgaggttagagatgttggtccactcagtaagaagggcttctacttggccttccaggatgtgggagcatgcattgcccttgtgtctgtccgagtgttctacaagaagtgtccattgactgtaagaaacttggcacagttccctgacaccattacaggttcagacacctcttctttggtggaagttcgaggctcttgtgtagacaactcagaagagaaagatgtgcctaagatgtactgtggtgctgatggagagtggctggtgcccattggaaactgcttatgtaacgctgggtttgaggagcacaatggaggatgccaagcctgcaaagttggatactacaaagccctctcaacagatgcagcttgctccaagtgtcccccacacagttatgctctccgggaaggctcaacctcctgcacctgtgaccgtggctattttcgagctgacactgacccggcttctatgccctgcactagacccccatctgctcctcagaacctaatctcaaacgtcaatgagacatctgtgaatttggagtggagtccgccacaaaattctggtggaaggcctgatgtctcctacaatttggtctgtaaaaggtgcggctctgacctgactcgctgtcggccttgtggcagtggagtgcactatagcccccagcaaaatggcctgaaaactaccaaagtgtccatcactgacctgcaagcccataccaactacacatttgaggtctggtccattaatggtgtctccaagcagaaccctggacaagatcaggccgtgtcagttactgtgaccaccaaccaagctgctccatcaactgtaacccagatacagccaaaagacatcaccaggcacagcgtgtctttgacttggccagagcctgagcgacccaatggcgtcatactggaatacgaagtcaagtattatgaaaaggaccagaatgagcgtacgtaccgcattgtgaagacaacctcgcggagtgcagacatcaaaggtctcaatccccttacggcctatgtgttccatgtccgtgctcgaactgctgcaggatatggggagtttagtggaccctttgagttcaccactaatacagtgccatcccctatgattggagaaggagccagccccactgtgcttttggtgtccgttgctggaagtattgtccttgtggttattctcattgctgcatttgtcatcagcagaaggcggagtaaatacagtaaagccaagcaagaagcagatgaggaaaaacatttaaaccaaggagtgaagacgtatgtggacccatttacttatgaagatcctaaccaggcagtccgtgaatttgcaaaggaaatcgatgcctcttgtattaagatcgaaaaagtcattggagtaggtgaatttggtgaagtttgtagtgggcgtctgaaggtccccggaaagagagagatttatgttgcaataaagactttgaaagctggttacaccgataagcagaggagagactttctaagtgaggccagcatcatgggtcagtttgaccatcccaacatcatccaccttgaaggtgttgtcaccaaatgcaagccagtgatgataattaccgagtacatggagaacggatccttggatgcattccttcgaaagaatgacgggcggtttacggtgatacagcttgtgggaatactgcgtggcattgggtctggaatgaaatacctctcagatatgagttatgtacatcgggacctagctgctcgtaatatccttgtgaacagcaatctagtctgtaaggtctctgacttcggcatgtctcgagtgctggaagatgaccctgaagcagcctacacaaccaggggtggcaagatcccgatccgatggacagcaccagaagctattgcgtacaggaaattcacctctgccagcgatgtctggagctatggcattgtcatgtgggaagtcatgtcttatggagagaggccctactgggatatgtccaatcaagacgttattaaagcaatcgaggaaggatacaggctgcccccaccaatggactgccctatcgcactgcatcagctcatgttggactgctggcagaaggagcgtagtgaccgaccaaagtttgggcaaatagtcagcatgctggataagctcatcaggaacccaaacagtttgaaaaggactggtctggacaattcaagcagaacaaatacgactctgctggaccccagctcgcctgaatggtcccaggtggcttctgtgcttgattggctgcaggccatcaaaatggaaagatacaaagataacttcacagcggccggatacaccagcttggaagcagtcgtgcatgtaaatcaagatgacctgaccaggattggcattagttccccttcacaccagaacaagattctgagcagtgttcagggaatgaggacccagatgcagcaaattcaaggcaggatggttcctgtttga

SEQ ID NO: 54 - protein, 986 aa, Xenopus laevis
MAGIVHGILFCGLFGLCWAVTGSRIYPASEVTLLDSRSVQGELGWIASPLEGGWEEVSIMDEKNTPIRTYQVCNVMESSQNNWLRTDWIPRSGAQRVYVEIKFTLRDCNSLPGVMGTCKETFNLYYYESNNDKERFIRETQYVKIDTIAADESFTQVDIGDRIMKLNTEVRDVGPLSKKGFYLAFQDVGACIALVSVRVFYKKCPLTVRNLAQFPDTITGSDTSSLVEVRGSCVDNSEEKDVPKMYCGADGEWLVPIGNCLCNAGFEEHNGGCQACKVGYYKALSTDAACSKCPPHSYALREGSTSCTCDRGYFRADTDPASMPCTRPPSAPQNLISNVNETSVNLEWSPPQNSGGRPDVSYNLVCKRCGSDLTRCRPCGSGVHYSPQQNGLKTTKVSITDLQAHTNYTFEVWSINGVSKQNPGQDQAVSVTVTTNQAAPSTVTQIQPKDITRHSVSLTWPEPERPNGVILEYEVKYYEKDQNERTYRIVKTTSRSADIKGLNPLTAYVFHVRARTAAGYGEFSGPFEFTTNTVPSPMIGEGASPTVLLVSVAGSIVLVVILIAAFVISRRRSKYSKAKQEADEEKHLNQGVKTYVDPFTYEDPNQAVREFAKEIDASCIKIEKVIGVGEFGEVCSGRLKVPGKREIYVAIKTLKAGYTDKQRRDFLSEASIMGQFDHPNIIHLEGVVTKCKPVMIITEYMENGSLDAFLRKNDGRFTVIQLVGILRGIGSGMKYLSDMSYVHRDLAARNILVNSNLVCKVSDFGMSRVLEDDPEAAYTTRGGKIPIRWTAPEAIAYRKFTSASDVWSYGIVMWEVMSYGERPYWDMSNQDVIKAIEEGYRLPPPMDCPIALHQLMLDCWQKERSDRPKFGQIVSMLDKLIRNPNSLKRTGLDNSSRTNTTLLDPSSPEWSQVASVLDWLQAIKMERYKDNFTAAGYTSLEAVVHVNQDDLTRIGISSPSHQNKILSSVQGMRTQMQQIQGRMVPV

SEQ ID NO: 55 - DNA, 2961 bp, Danio rerio
  CDS (1)..(2958)
atggctgcgcttgtgttcacagcgacttttgcgctaataatctggataccgactttcgtattaaccgcacgggtctaccctcctaatgaagtgacactgctggactcgagaactgtgcaaggagaattgaaatgggttgcaagtccgacggaaggagggtgggaagaggtgagcatcatggatgagaagaatacgccaatcaggacgtaccaggtgtgcaacgtaatggaacccagccagaacaactggctccgaacggactggatcccccgtggcggagctcagcgggtctacatcgagatcaaattcaccctgcgtgactgcaacagcctgccaggagtcatgggaacctgcaaggagacctttaatctttactattatgagtccaacaatgacaaagagcgatacatccgagaaaaccagttcaccaaaatcgacaccattgcggctgatgaaagcttcacgcaggtggacataggagaccgcatcatgaagctgaacacggaggtgagggatgtggggattttgacaaggaagggcttctacctggccttccaggacgttggggcttgcattgccttggtatcagtacggatcttctacaagaaatgcccgcttactgtacgcaacctggcccaatttccagacaccaccaccggggcagacacctcatcgctagtggaggtacgcggatcctgtgtggacaattcggaggaacgtgaggtccctaaaatgtactgcggagcagatggagaatggctggtgcctattggaaactgtttgtgtaaccctggctatgaagaacatgaagggacatgtcaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtctccaaacagagtccwggacccgaacaagcagtctctgtgactgttaccaccaaccaagcggctccctctccagttaccaccatccaggccaaggacatcacaagacatgctgtgtctttggcatggcaacaacccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcactggatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacccattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgccgcacaccaggataagatcctcaacagcgcgcagggaatgttgtcccagatgcagcaaatgcaggacaggatggttcctgtctga

SEQ ID NO: 56 - protein, 986 aa, Danio rerio
  misc_feature (423)..(423): The 'Xaa' at location 423 stands for Pro.
MAALVFTATFALIIWIPTFVLTARVYPPNEVTLLDSRTVQGELKWVASPTEGGWEEVSIMDEKNTPIRTYQVCNVMEPSQNNWLRTDWIPRGGAQRVYIEIKFTLRDCNSLPGVMGTCKETFNLYYYESNNDKERYIRENQFTKIDTIAADESFTQVDIGDRIMKLNTEVRDVGILTRKGFYLAFQDVGACIALVSVRIFYKKCPLTVRNLAQFPDTTTGADTSSLVEVRGSCVDNSEEREVPKMYCGADGEWLVPIGNCLCNPGYEEHEGTCQACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSXGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 57 - DNA, 2214 bp, Danio rerio
  CDS (1)..(2211)
atggacaatgagagcatgattgttctcctattgtccaagccagtggtcagaggcttcatggagagagggaggaaagcctgtaagatcggtaactacagagctctagccacagacggcagctgctctaagtgtcccctgcacagctactctgtgagagagggatctacttcctgtgcctgtgataaaggcttcttcaggtctgagacggaccctgcatctatgccctgcacacagcccccatctgctcctcagcacctcatttccaatgtgaacgagacttcggtaaatctggagtggacggctccagcatcctctggtggcagacaggaccttgcctataacgttatatgcaagcggtgcagctcggacggtcaacgctgtcagccctgcggcaatggcatccatttttcccctcagcagctgggtctacgcactacccgggtgtccataaatgacctgcaggctcacaccaactacaccttcgagatctgggcagtcaacggggtgtccaaacagagtcctggacccgaacaagcagtctctgtgactgttaccaccaaccaagcggctccctctccagttaccaccatccaggccaaggacatcacaagacatgctgtgtctttggcatggcaacagcccgagagacccaatggagtcattcttgagtacgaggtcaaatactatgagaaggatcaaaacgagcgcagttatcgcataatgaagacttcgtcccgaagcgctgagatcaaaggcctgagcccactcacctcctacgtgtttcatgtgcgtgcccgcaccgctgctggctacggagaattcagtgccccttttgagttcatgaccaactcagttccttctcccatcatcggggacggagctaactccaccgtgctcttggtgtctgtgatcggcagtgtgattttgttgctcatcttcatcggcgtcttcatcatcagccgcaggagaagcaaatacagcaaagccaagcaggattctgatgaggagaggcatttacacccaggagtccggatctatgtggaccccttcacatacgaggaccccaaccaagcagtccgtgaattcgctaaagaaatcgacgcctcctgcatcaagatcgaaaaggtcatcggcattggagaattcggagaggtgtgcagtggccgtctcaagatgcctggaaagcgtgagatctgtgtggccataaaaaccctaaaggcaggatacaccgacaagcaaaggcgggattttctgagcgaggccagcatcatgggccagtttgaccaccctaacatcatccgattggagggagttgtcactaaatgtaagccagttatgatcatcacagagtacatggagaacggatcacttgatgcttttcttaggaagaatgatggacggtttacagtgattcagctggtgggcatcctgcgaggcattgcttcaggaatgaaatatctctccgatatgagctatgtccatcgtgacttggcggctcgcaacattctggtcaacagcaacctggtgtgcaaagtgtccgactttggcatgtctcgagttttggaggaagacccagatgctgcttataccaccagaggaggcaagatacctattcgctggacggctcctgaagccattacttacaggaagttcacctccgcatctgacgtctggagctatggcatcgtcatgtgggaagtgatgtcatatggagagcggccatattgggacatgagcaaccaggatgtgataaaggccattgaggaaggctacaggctgcctcctcccatggactgtccagtttctttgcaccagttgatgttggattgctggcagaaagagcgcgcagaaaggccaaagttcagtcaaattgtcaacatgctggacaaactcatccgcaaccctaacagcctgaaaaggacaggaggagaaatagccagacccaacaccaccctcctggagcctagcagcccagaattcacgtctaccctgggatcagttgccgactggctgcaggccatcaacatggaacgttacagagacaacttcaccgctgctggctataccactccagaagctgtggtccatatgacacaagaggacatgacgaggatagggatctccaccgctgcacaccaggataagatcctcaacagcgcgcagggaatgttgtcccagatgcagcaaatgcaggacaggatggttcctgtctga

SEQ ID NO: 58 - protein, 737 aa, Danio rerio
MDNESMIVLLLSKPVVRGFMERGRKACKIGNYRALATDGSCSKCPLHSYSVREGSTSCACDKGFFRSETDPASMPCTQPPSAPQHLISNVNETSVNLEWTAPASSGGRQDLAYNVICKRCSSDGQRCQPCGNGIHFSPQQLGLRTTRVSINDLQAHTNYTFEIWAVNGVSKQSPGPEQAVSVTVTTNQAAPSPVTTIQAKDITRHAVSLAWQQPERPNGVILEYEVKYYEKDQNERSYRIMKTSSRSAEIKGLSPLTSYVFHVRARTAAGYGEFSAPFEFMTNSVPSPIIGDGANSTVLLVSVIGSVILLLIFIGVFIISRRRSKYSKAKQDSDEERHLHPGVRIYVDPFTYEDPNQAVREFAKEIDASCIKIEKVIGIGEFGEVCSGRLKMPGKREICVAIKTLKAGYTDKQRRDFLSEASIMGQFDHPNIIRLEGVVTKCKPVMIITEYMENGSLDAFLRKNDGRFTVIQLVGILRGIASGMKYLSDMSYVHRDLAARNILVNSNLVCKVSDFGMSRVLEEDPDAAYTTRGGKIPIRWTAPEAITYRKFTSASDVWSYGIVMWEVMSYGERPYWDMSNQDVIKAIEEGYRLPPPMDCPVSLHQLMLDCWQKERAERPKFSQIVNMLDKLIRNPNSLKRTGGEIARPNTTLLEPSSPEFTSTLGSVADWLQAINMERYRDNFTAAGYTTPEAVVHMTQEDMTRIGISTAAHQDKILNSAQGMLSQMQQMQDRMVPV

SEQ ID NO: 59 - DNA, 1404 bp, Mus musculus
  CDS (1)..(1401)
atgacagagatacctgcacctttgtcctacttccagaatgcccagatgtctgaggacagccactccagcagcgccatccggagccagaatgacagccaagaacggcagcagcagcatgacaggcagagacttgacaaccctgagccaatatctaatgggcggccccagagtaactcaagacaggtggtggaacaagatgaggaggaagacgaagagctgacattgaaatatggagccaagcatgtcatcatgctctttgtccccgtgaccctctgcatggtcgtcgtcgtggccaccatcaaatcagtcagcttctatacccggaaggacggtcagctaatctacaccccattcacagaagacactgagactgtaggccaaagagccctgcactcgatcctgaatgcggccatcatgatcagtgtcattgtcattatgaccatcctcctggtggtcctgtataaatacaggtgctacaaggtcatccacgcctggcttattatttcatctctgttgttgctgttctttttttcgttcatttacttaggggaagtatttaagacctacaatgtcgccgtggactacgttacagtagcactcctaatctggaattttggtgtggtcgggatgattgccatccactggaaaggcccccttcgactgcagcaggcgtatctcattatgatcagtgccctcatggccctggtatttatcaagtacctccccgaatggaccgcatggctcatcttggctgtgatttcagtatatgatttggtggctgttttatgtcccaaaggcccacttcgtatgctggttgaaacagctcaggaaagaaatgagactctctttccagctcttatctattcctcaacaatggtgtggttggtgaatatggctgaaggagacccagaagcccaaaggagggtacccaagaaccccaagtataacacacaaagagcggagagagagacacaggacagtggttctgggaacgatgatggtggcttcagtgaggagtgggaggcccaaagagacagtcacctggggcctcatcgctccactcccgagtcaagagctgctgtccaggaactttctgggagcattctaacgagtgaagacccggaggaaagaggagtaaaacttggactgggagatttcattttctacagtgttctggttggtaaggcctcagcaaccgccagtggagactggaacacaaccatagcctgctttgtagccatactgatcggcctgtgccttacattactcctgctcgccattttcaagaaagcgttgccagccctccccatctccatcaccttcgggctcgtgttctacttcgccacggattaccttgtgcagcccttcatggaccaacttgcattccatcagttttatatctag

SEQ ID NO: 60 - protein, 467 aa, Mus musculus
MTEIPAPLSYFQNAQMSEDSHSSSAIRSQNDSQERQQQHDRQRLDNPEPISNGRPQSNSRQVVEQDEEEDEELTLKYGAKHVIMLFVPVTLCMVVVVATIKSVSFYTRKDGQLIYTPFTEDTETVGQRALHSILNAAIMISVIVIMTILLVVLYKYRCYKVIHAWLIISSLLLLFFFSFIYLGEVFKTYNVAVDYVTVALLIWNFGVVGMIAIHWKGPLRLQQAYLIMISALMALVFIKYLPEWTAWLILAVISVYDLVAVLCPKGPLRMLVETAQERNETLFPALIYSSTMVWLVNMAEGDPEAQRRVPKNPKYNTQRAERETQDSGSGNDDGGFSEEWEAQRDSHLGPHRSTPESRAAVQELSGSILTSEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 61 - DNA, 1407 bp, Rattus norvegicus
  CDS (1)..(1404)
atgacagagatacctgcacctttgtcctacttccagaatgcacagatgtctgaggacagccactccagcagcgtccgtagccagaatgacaatcaagaacggcagcagcatcatgacagacagagacttgacaaccctgagtcgatatctaatggccgaccccagagtaactttaccaggcaggtgatagagcaagatgaggaggaagacgaagagctgacattgaaatatggagccaagcacgtcatcatgctctttgttcctgtgaccctctgcatggtcgttgtggtggccactatcaagtcagtcagcttctacacccggaaggatgggcagctaatctataccccattcacagaagacaccgagactgtaggccagagagccctgcactcgatcttgaatgccgccatcatgatcagtgtcatcgtcgttatgaccatcctcctggtggtcctgtataagtacaggtgctacaaggtcatccatgcctggcttattgtttcatctctgttgttgctgttctttttttcattcatttacttaggggaagtattcaagacctacaatgtcgccgtggactatattacggttgcactcctgatctggaattttggtgtggtcgggatgattgccattcactggaaaggcccactccgactgcagcaggcgtatctcattatgatcagtgccctcatgtccctggtatttatcaagtacctccctgaatggaccgcatggctcatcttggctgtgatttcagtatatgatttggtggctgttctgtgccccaaaggtccacttcgtatgctggtcgaaacagctcaggaaagaaatgagactctctttccagctcttatctattcctcaaccatggtgtggttggtgaatatggctgaaggagacccagaagcccaaaggagggtacccaaaaaccccaagtatagcacacaaggaacagagagggaagagacacaggacactggcactgggagcgatgatggtggcttcagtgaggagtgggaggcccaaagagacagtcacctggggcctcatcgctccactcctgagtcaagagctgctgtccaggaactttctgggagcatcctcactagtgaagacccggaggaaagaggagtaaggcttgggctgggagatttcattttctacagtgttctggttggtaaggcctcagcgaccgccagtggggactggaacacaaccatagcctgctttgtagccatattgatcggcctgtgccttacgttactcctgctcgccattttcaagaaagcgttgccggcccttcccatctccatcaccttcgggctcattttctactttgccacggattatctcgtgcagcccttcatggaccaacttgcattccatcaattttatatctag

SEQ ID NO: 62 - protein, 468 aa, Rattus norvegicus
MTEIPAPLSYFQNAQMSEDSHSSSVRSQNDNQERQQHHDRQRLDNPESISNGRPQSNFTRQVIEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIVSSLLLLFFFSFIYLGEVFKTYNVAVDYITVALLIWNFGVVGMIAIHWKGPLRLQQAYLIMISALMSLVFIKYLPEWTAWLILAVISVYDLVAVLCPKGPLRMLVETAQERNETLFPALIYSSTMVWLVNMAEGDPEAQRRVPKNPKYSTQGTEREETQDTGTGSDDGGFSEEWEAQRDSHLGPHRSTPESRAAVQELSGSILTSEDPEERGVRLGLGDFIFYSVLVGKASATASGDWNTTIACFVAILIGLCLTLLLLAIFKKALPALPISITFGLIFYFATDYLVQPFMDQLAFHQFYI

SEQ ID NO: 63 - DNA, 1404 bp, Homo sapiens
  CDS (1)..(1401)
atgacagagttacctgcaccgttgtcctacttccagaatgcacagatgtctgaggacaaccacctgagcaatactgtacgtagccagaatgacaatagagaacggcaggagcacaacgacagacggagccttggccaccctgagccattatctaatggacgaccccagggtaactcccggcaggtggtggagcaagatgaggaagaagatgaggagctgacattgaaatatggcgccaagcatgtgatcatgctctttgtccctgtgactctctgcatggtggtggtcgtggctaccattaagtcagtcagcttttatacccggaaggatgggcagctaatctataccccattcacagaagataccgagactgtgggccagagagccctgcactcaattctgaatgctgccatcatgatcagtgtcattgttgtcatgactatcctcctggtggttctgtataaatacaggtgctataaggtcatccatgcctggcttattatatcatctctattgttgctgttctttttttcattcatttacttgggggaagtgtttaaaacctataacgttgctgtggactacattactgttgcactcctgatctggaattttggtgtggtgggaatgatttccattcactggaaaggtccacttcgactccagcaggcatatctcattatgattagtgccctcatggccctggtgtttatcaagtacctccctgaatggactgcgtggctcatcttggctgtgatttcagtatatgatttagtggctgttttgtgtccgaaaggtccacttcgtatgctggttgaaacagctcaggagagaaatgaaacgctttttccagctctcatttactcctcaacaatggtgtggttggtgaatatggcagaaggagacccggaagctcaaaggagagtatccaaaaattccaagtataatgcagaaagcacagaaagggagtcacaagacactgttgcagagaatgatgatggcgggttcagtgaggaatgggaagcccagagggacagtcatctagggcctcatcgctctacacctgagtcacgagctgctgtccaggaactttccagcagtatcctcgctggtgaagacccagaggaaaggggagtaaaacttggattgggagatttcattttctacagtgttctggttggtaaagcctcagcaacagccagtggagactggaacacaaccatagcctgtttcgtagccatattaattggtttgtgccttacattattactccttgccattttcaagaaagcattgccagctcttccaatctccatcacctttgggcttgttttctactttgccacagattatcttgtacagccttttatggaccaattagcattccatcaattttatatctag

SEQ ID NO: 64 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 65 - DNA, 1347 bp, Mus musculus
  CDS (1)..(1344)
atgctcgcattcatggcctctgacagcgaggaagaggtgtgtgatgagcggacgtccttgatgtcagccgagagccccacatctcgctcctgccaggaaggcaggccaggcccggaggatggagagagcactgcccagtggaggactcaggagagcgaagaagactgtgaagaggacccggaccgctacgcatgcagtggggctcctgggcgaccgtcgggcctggaggaagagctgaccctcaagtatggggcgaaacgtgtgatcatgctattcgtgcctgtcacgctgtgtatgatcgtggtggtggccactatcaagtctgtgcgtttctacactgagaagaacgggcagctcatctacacgcccttcacggaggacacgccctcggtgggccagcggctcctcaactccgtgcttaacaccctcatcatgatcagcgtcatcgtagtcatgaccatcttcctcgtggtactctacaagtatcgatgctacaagttcatccatggctggctgatcatgtcctccctgatgctcctcttcttgttcacctacatctacctcggggaagtgctcaagacctacaatgtggccatggactatcccacactcttcctggctgtctggaacttcggggcagtgggcatggtgtgcatccactggaaggggcctctagcgctgcagcaggcttaccttattgtgatcagcgcactcatggccctggtgttcatcaagtacctgccggagtggtctgcctgggtcatcttgggtgccatctctgtgtacgatctcgtggccgtgctgtgccccaaagggccactgaggatgctggtggaaactgcccaggagagaaatgagcccatatttcctgccctgatatactcatctgccatggtgtggacggtgggcatggcaaagctggacccctcctctcaaggagcgctgcagctcccctatgacccagagatggaagaagactcctacgacagttttggagaaccctcataccctgaagccttcgaagcccccctgcctggctacccaggggaggagctggaggaggaggaggaaaggggcgtgaagctcggcctgggagacttcatcttctacagcgtcctggtgggcaaggctgcagccactggcaacggagactggaacactacgctggcctgttttatcgccatcctcattggcttgtgtctcaccctcctgctgcttgctgtgttcaagaaggctctgcccgccctccccatctccatcacctttggactcatcttctacttctccacagacaacctggtgcgccctttcatggacactctggcctcccaccagctctacatctga

SEQ ID NO: 66 - protein, 448 aa, Mus musculus
MLAFMASDSEEEVCDERTSLMSAESPTSRSCQEGRPGPEDGESTAQWRTQESEEDCEEDPDRYACSGAPGRPSGLEEELTLKYGAKRVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLFLAVWNFGAVGMVCIHWKGPLALQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPLPGYPGEELEEEEERGVKLGLGDFIFYSVLVGKAAATGNGDWNTTLACFIAILIGLCLTLLLLAVFKKALPALPISITFGLIFYFSTDNLVRPFMDTLASHQLYI

SEQ ID NO: 67 - DNA, 1347 bp, Rattus norvegicus
  CDS (1)..(1344)
atgctcacattcatggcctctgatagcgaggaagaggtgtgcgatgagcggacgtccttgatgtcagccgagagccctacatcacgttcctgccaggacagcaggccaggcccagaggatggagagaacactgcccagtggaggagccaggagaacgaggacgactgtgaggaggacccggaccactatgcctgcagtggggttcctgggcgaccatcgggcctggaggaggagctgaccctcaagtatggggcgaagcacgtgatcatgctgttcgtgcctgtcacgctgtgcatgattgtggtggtggccaccatcaagtccgtgcgtttctacacggagaagaacgggcagctcatctacacgcccttcaccgaggacacaccctctgtgggccagcggctcctcaactccgtgctgaacactctgatcatgatcagcgtcattgtggtcatgactatcttcctagtggtactctacaaatatcgctgttacaagttcatccatggctggctgatcatgtcctccctgatgctcctcttcttgttcacctacatctacctcggggaagtgttcaagacctacaatgtggccatggactaccccacactgttcctggctgtctggaacttcggggcagtgggcatggtgtgcatccactggaagggtcccctggtgctccagcaggcttacctcattgtgatcagcgcactcatggccctggtgttcatcaagtacctgccggagtggtccgcttgggtcatcttgggcgccatctctgtgtacgatctcgtggctgtgctgtgccccaaagggccactgaggatgctggtggaaactgcccaggaaagaaacgagcccatatttcctgccctcatatactcatctgccatggtgtggacggtaggcatggcgaagctggacccctcctctcagggagcactgcagctcccttacgatccagagatggaagaagactcctatgacagttttggggaaccctcataccctgaagccttcgaagctccccagcctggctacccaggggaagagccggaggaggaggaggaaaggggtgtaaagcttggtctgggagacttcatcttctacagcgttctggtgggcaaggcagcagccacaggcaacggagactggagcacgacgctggcctgctttatcgccatcctcattggcttgtgtctcaccctcctgctgctcgccgtgttcaagaaggccctgcccgccctccccatctccatcaccttcgggctcatcttttacttctccacagacaacctggtgcgtcctttcatggacacgttggcctcccaccagctctacatctga

SEQ ID NO: 68 - protein, 448 aa, Rattus norvegicus
MLTFMASDSEEEVCDERTSLMSAESPTSRSCQDSRPGPEDGENTAQWRSQENEDDCEEDPDHYACSGVPGRPSGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVFKTYNVAMDYPTLFLAVWNFGAVGMVCIHWKGPLVLQQAYLIVISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEAFEAPQPGYPGEEPEEEEERGVKLGLGDFIFYSVLVGKAAATGNGDWSTTLACFIAILIGLCLTLLLLAVFKKALPALPISITFGLIFYFSTDNLVRPFMDTLASHQLYI

SEQ ID NO: 69 - DNA, 1347 bp, Homo sapiens
  CDS (1)..(1344)
atgctcacattcatggcctctgacagcgaggaagaagtgtgtgatgagcggacgtccctaatgtcggctgagagccccacgccgcgctcctgccaggagggcaggcagggcccagaggatggagagaacactgcccagtggagaagccaggagaacgaggaggacggtgaggaggaccctgaccgctatgtctgtagtggggttcccgggcggccgccaggcctggaggaagagctgaccctcaaatacggagcgaagcacgtgatcatgctgtttgtgcctgtcactctgtgcatgatcgtggtggtagccaccatcaagtctgtgcgcttctacacagagaagaatggacagctcatctacacgccattcactgaggacacaccctcggtgggccagcgcctcctcaactccgtgctgaacaccctcatcatgatcagcgtcatcgtggttatgaccatcttcttggtggtgctctacaagtaccgctgctacaagttcatccatggctggttgatcatgtcttcactgatgctgctgttcctcttcacctatatctaccttggggaagtgctcaagacctacaatgtggccatggactaccccaccctcttgctgactgtctggaacttcggggcagtgggcatggtgtgcatccactggaagggccctctggtgctgcagcaggcctacctcatcatgatcagtgcgctcatggccctagtgttcatcaagtacctcccagagtggtccgcgtgggtcatcctgggcgccatctctgtgtatgatctcgtggctgtgctgtgtcccaaagggcctctgagaatgctggtagaaactgcccaggagagaaatgagcccatattccctgccctgatatactcatctgccatggtgtggacggttggcatggcgaagctggacccctcctctcagggtgccctccagctcccctacgacccggagatggaagaagactcctatgacagttttggggagccttcataccccgaagtctttgagcctcccttgactggctacccaggggaggagctggaggaagaggaggaaaggggcgtgaagcttggcctcggggacttcatcttctacagtgtgctggtgggcaaggcggctgccacgggcagcggggactggaataccacgctggcctgcttcgtggccatcctcattggcttgtgtctgaccctcctgctgcttgctgtgttcaagaaggcgctgcccgccctccccatctccatcacgttcgggctcatcttttacttctccacggacaacctggtgcggccgttcatggacaccctggcctcccatcagctctacatctga

SEQ ID NO: 70 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 71 - DNA, 2127 bp, Mus musculus
  CDS (1)..(2124)
atggctacgactaggggcggctctgggcctgacccaggaagtcggggtcttcttcttctgtctttttccgtggtactggcaggattgtgtgggggaaactcagtggagaggaaaatctacattcccttaaataaaacagctccttgtgtccgcctgctcaacgccactcatcagattggctgccagtcttcaattagtggggatacaggggttatccacgtagtggagaaagaagaagacctgaagtgggtgttgaccgatggccccaaccccccttacatggttctgctggagggcaagctcttcaccagagatgtaatggagaagctgaagggaacaaccagtagaatcgctggtcttgccgtgactctagccaagcccaactcaacttcaagcttctctcctagtgtgcagtgcccaaatgatgggtttggtatttactccaactcctacgggccagagtttgctcactgcaagaaaacactgtggaatgaactgggcaacggcttggcttatgaagactttagtttccccatctttcttcttgaagatgagaacgaaaccaaggtcatcaagcagtgctatcaagatcacaacctgggtcagaatggctctgcaccaagcttcccattgtgtgctatgcagctcttctcacacatgcacgccgtcatcagcactgccacctgcatgcggcgcagcttcatccagagcaccttcagcatcaacccagaaatcgtctgtgaccccttatctgactacaacgtatggagcatgcttaagcctataaatacatctgtgggactagaacctgacgtcagggttgtggttgcggccacacggctggatagccggtcctttttctggaatgtggccccaggggctgaaagtgctgtagcctcctttgtcactcagctggctgcagctgaagctttgcacaaggcacctgatgtgaccactctatcccgaaatgtgatgtttgtcttcttccagggggaaacttttgactacattggcagctcacggatggtctatgatatggagaacggcaagtttcccgtgcggctcgagaacatcgactccttcgtggagctgggacaggtggccctaagaacttcactagatctctggatgcacacagatcccatgtctcagaaaaatgagtctgtgaaaaaccaggtggaggatcttctggccactctggagaagagcggtgctggtgtccctgaagttgtcctgaggagactggcccagtcccaggcccttccaccttcatctctacaacgatttcttcgggctcgaaacatctctggcgtggtcctggctgaccactctggctccttccacaatcggtattaccagagcatttatgacacggctgagaacattaatgtgacctatcctgagtggcagagcccagaagaggacctcaactttgtgacagacactgccaaggcactggcgaatgtggccacagtgctggcgcgtgcactgtatgagcttgcaggaggaaccaacttcagcagctccatccaggctgatccccagacagttacacgtctgctctatgggttcctggttaaagctaacaactcatggtttcagtcgatcctgaaacatgacctaaggtcctatttggatgacaggcctcttcaacactacatcgccgtctccagccctaccaacacgacttacgttgtgcagtacgccttggcaaacctgactggcaaggcgaccaacctcacccgagagcagtgccaggatccaagtaaagtcccaaatgagagcaaggatttatatgaatactcgtgggtacaaggcccttggaattccaacaggacagagaggctcccacagtgtgtgcgctccacagtgcgactggccagggccttgtcccctgcctttgaactgagtcagtggagctccacagaatactctacgtgggcggagagccgctggaaagacatccaagctcggatattcctaattgccagcaaagagcttgagttcatcacgctgatcgtgggcttcagcatccttatcttctctctcatcgtcacctactgcatcaatgccaaagccgacgtcctttttgttgctccccgagagccaggagctgtgtcttactga

SEQ ID NO: 72 - protein, 708 aa, Mus musculus
MATTRGGSGPDPGSRGLLLLSFSVVLAGLCGGNSVERKIYIPLNKTAPCVRLLNATHQIGCQSSISGDTGVIHVVEKEEDLKWVLTDGPNPPYMVLLEGKLFTRDVMEKLKGTTSRIAGLAVTLAKPNSTSSFSPSVQCPNDGFGIYSNSYGPEFAHCKKTLWNELGNGLAYEDFSFPIFLLEDENETKVIKQCYQDHNLGQNGSAPSFPLCAMQLFSHMHAVISTATCMRRSFIQSTFSINPEIVCDPLSDYNVWSMLKPINTSVGLEPDVRVVVAATRLDSRSFFWNVAPGAESAVASFVTQLAAAEALHKAPDVTTLSRNVMFVFFQGETFDYIGSSRMVYDMENGKFPVRLENIDSFVELGQVALRTSLDLWMHTDPMSQKNESVKNQVEDLLATLEKSGAGVPEVVLRRLAQSQALPPSSLQRFLRARNISGVVLADHSGSFHNRYYQSIYDTAENINVTYPEWQSPEEDLNFVTDTAKALANVATVLARALYELAGGTNFSSSIQADPQTVTRLLYGFLVKANNSWFQSILKHDLRSYLDDRPLQHYIAVSSPTNTTYVVQYALANLTGKATNLTREQCQDPSKVPNESKDLYEYSWVQGPWNSNRTERLPQCVRSTVRLARALSPAFELSQWSSTEYSTWAESRWKDIQARIFLIASKELEFITLIVGFSILIFSLIVTYCINAKADVLFVAPREPGAVSY

SEQ ID NO: 73 - DNA, 2127 bp, Rattus norvegicus
  CDS (1)..(2124)
atggctacggctaggggcggctctgggcctgacccaggaagtcggggtctccttcttctgtctttttccgtggtactagcaggattgtgtgggggaaactcagtggagaggaagatctacattcccttaaataaaacagctccttgtgtccgcctgctcaatgccactcatcagattggctgccagtcttcaattagtggggatacaggggttatccacgtagtggagaaagaagacgacctgaaatgggtattgacggatggccccaaccccccttacatggttctgctggagggcaagctctttaccagagatataatggaaaagctgaagggggaaaccagtagaatcgctggtcttgccgtgactctagccaagcccaattcaacgtcaagcttctctcctagcgtgcagtgcccaaatgatgggtttggtatttactccaactcctatgggccagagtttgctcactgcaaaaaaacattgtggaatgaactgggcaatggcttggcttatgacgacttcagtttccccatctttcttcttgaagatgagaacgaaaccaaggtcatcaagcagtgctatcaagatcacaacctgggtcagaatggctctgcaccgagcttcccactgtgtgctatgcagctcttctcacacatgcacgccgtcatcagcaccgccacctgcatgcgacgcagcttcatccagagcaccttcagcatcaacccagaaatcgtctgtgaccccttatccgactacaacgtatggagcatgcttaagcctataaatacgtctgggggattagaacctgatgtcagggttgtggttgcagccacacggctggatagccggtccttcttctggaatgtggccccaggggcagaaagtgccgttgcctcctttgtcactcagctggccgcagctgaagctttgcacaaggcacctgatgtgaccaccctaccccgaaatgtgatgtttgtcttcttccagggggaaacttttgactacattggcagctcaaggatggtctatgacatggagaacggcaagtttcctgtgcggctagagaacattgactcctttgtggagctggggcaggtggccctaaggacgtcactagaactctggatgcacacagatcctatgtctcagaaaaatgaatctgtgaagaaccaggtggaggatcttctggtcactctggagcagagtggtgctgatacccctcaagttgtcctgagcagactagtccagtcccaggcccttccaccatcatctctacaacgatttcttcgggctcgaaacatctctggtgtggtcttggctgaccactctggttccttccacaatcggtattaccagagcatttatgacactgctgagaacattaacgtgacctatcctgagtcgcagagcccagaagaggacctcaactttgtaacagacactgccaaggcactggcagatgttgccacagtgctggcacgagctttgtacaagcttgcaggaggaaccaacttcaacaactccattcaggctgatccccagacagttacacgtctgctctatgggttcctggtcagagctaacaactcatggtttcagtctatcctcagacatgatctgaggtcctatttggatgatgggcctcttcaacactacatcgctgtctccagccctaccaacacgacttacgttgtgcagtatgccttggcaaacctgactggcaaggtgaccaacctcacccaagagcagtgccaggatccaagtaaagtcccaaatgaaagcaaggatttgtatgaatactcgtgggtacaaggcccttggaattccaacaagacagagcggctcccacggtgtgtgcgctccacagtacgactggctagggccttgtcccccgcctttgagctgagtcagtggagctccacagaatactctacgtgggccgagagccgctggaaagatatccaagctcggatattcctcattgccagcaaagaacttgagttcatcacgctgatcgtgggcttcagcatcctcgtcttttctctcatcgtcacttattgtatcaacgccaaggccgatgtccttttcgttgctccccgagagccaggagctgtgtcttactga

SEQ ID NO: 74 - protein, 708 aa, Rattus norvegicus
MATARGGSGPDPGSRGLLLLSFSVVLAGLCGGNSVERKIYIPLNKTAPCVRLLNATHQIGCQSSISGDTGVIHVVEKEDDLKWVLTDGPNPPYMVLLEGKLFTRDIMEKLKGETSRIAGLAVTLAKPNSTSSFSPSVQCPNDGFGIYSNSYGPEFAHCKKTLWNELGNGLAYDDFSFPIFLLEDENETKVIKQCYQDHNLGQNGSAPSFPLCAMQLFSHMHAVISTATCMRRSFIQSTFSINPEIVCDPLSDYNVWSMLKPINTSGGLEPDVRVVVAATRLDSRSFFWNVAPGAESAVASFVTQLAAAEALHKAPDVTTLPRNVMFVFFQGETFDYIGSSRMVYDMENGKFPVRLENIDSFVELGQVALRTSLELWMHTDPMSQKNESVKNQVEDLLVTLEQSGADTPQVVLSRLVQSQALPPSSLQRFLRARNISGVVLADHSGSFHNRYYQSIYDTAENINVTYPESQSPEEDLNFVTDTAKALADVATVLARALYKLAGGTNFNNSIQADPQTVTRLLYGFLVRANNSWFQSILRHDLRSYLDDGPLQHYIAVSSPTNTTYVVQYALANLTGKVTNLTQEQCQDPSKVPNESKDLYEYSWVQGPWNSNKTERLPRCVRSTVRLARALSPAFELSQWSSTEYSTWAESRWKDIQARIFLIASKELEFITLIVGFSILVFSLIVTYCINAKADVLFVAPREPGAVSY

SEQ ID NO: 75 - DNA, 2130 bp, Homo sapiens
  CDS (1)..(2127)
atggctacggcagggggtggctctggggctgacccgggaagtcggggtctccttcgccttctgtctttctgcgtcctactagcaggtttgtgcaggggaaactcagtggagaggaagatatatatccccttaaataaaacagctccctgtgttcgcctgctcaacgccactcatcagattggctgccagtcttcaattagtggagacacaggggttatccacgtagtagagaaagaggaggacctacagtgggtattgactgatggccccaaccccccttacatggttctgctggagagcaagcattttaccagggatttaatggagaagctgaaagggagaaccagccgaattgctggtcttgcagtgtccttgaccaagcccagtcctgcctcaggcttctctcctagtgtacagtgcccaaatgatgggtttggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccagaaatcgtctgtgaccccctgtctgattacaatgtgtggagcatgctaaagcctataaatacaactgggacattaaagcctgacgacagggttgtggttgctgccacccggctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggaaacttttgactacattggcagctcgaggatggtctacgatatggagaagggcaagtttcccgtgcagttagagaatgttgactcatttgtggagctgggacaggtggccttaagaacttcattagagctttggatgcacacagatcctgtttctcagaaaaatgagtctgtacggaaccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaaatattaccagagtatttacgacactgctgagaacattaatgtgagctatcccgaatggctgagccctgaagaggacctgaactttgtaacagacactgccaaggccctggcagatgtggccacggtgctgggacgtgctctgtatgagcttgcaggaggaaccaacttcagcgacacagttcaggctgatccccaaacggttacccgcctgctctatgggttcctgattaaagccaacaactcatggttccagtctatcctcaggcaggacctaaggtcctacttgggtgacgggcctcttcaacattacatcgctgtctccagccccaccaacaccacttatgttgtacagtatgccttggcaaatttgactggcacagtggtcaacctcacccgagagcagtgccaggatccaagtaaagtcccaagtgaaaacaaggatctgtatgagtactcatgggtccagggccctttgcattctaatgagacggaccgactcccccggtgtgtgcgttctactgcacgattagccagggccttgtctcctgcctttgaactgagtcagtggagctctactgaatactctacatggactgagagccgctggaaagatatccgtgcccggatatttctcatcgccagcaaagagcttgagttgatcaccctgacagtgggcttcggcatcctcatcttctccctcatcgtcacctactgcatcaatgccaaagctgatgtccttttcattgctccccgggagccaggagctgtgtcatactga

SEQ ID NO: 76 - protein, 709 aa, Homo sapiens
MATAGGGSGADPGSRGLLRLLSFCVLLAGLCRGNSVERKIYIPLNKTAPCVRLLNATHQIGCQSSISGDTGVIHVVEKEEDLQWVLTDGPNPPYMVLLESKHFTRDLMEKLKGRTSRIAGLAVSLTKPSPASGFSPSVQCPNDGFGVYSNSYGPEFAHCREIQWNSLGNGLAYEDFSFPIFLLEDENETKVIKQCYQDHNLSQNGSAPTFPLCAMQLFSHMHAVISTATCMRRSSIQSTFSINPEIVCDPLSDYNVWSMLKPINTTGTLKPDDRVVVAATRLDSRSFFWNVAPGAESAVASFVTQLAAAEALQKAPDVTTLPRNVMFVFFQGETFDYIGSSRMVYDMEKGKFPVQLENVDSFVELGQVALRTSLELWMHTDPVSQKNESVRNQVEDLLATLEKSGAGVPAVILRRPNQSQPLPPSSLQRFLRARNISGVVLADHSGAFHNKYYQSIYDTAENINVSYPEWLSPEEDLNFVTDTAKALADVATVLGRALYELAGGTNFSDTVQADPQTVTRLLYGFLIKANNSWFQSILRQDLRSYLGDGPLQHYIAVSSPTNTTYVVQYALANLTGTVVNLTREQCQDPSKVPSENKDLYEYSWVQGPLHSNETDRLPRCVRSTARLARALSPAFELSQWSSTEYSTWTESRWKDIRARIFLIASKELELITLTVGFGILIFSLIVTYCINAKADVLFIAPREPGAVSY

SEQ ID NO: 77 - DNA, 744 bp, Mus musculus
  CDS (1)..(741)
atgggggctgctgtgtttttcggatgcaccttcgtcgcgttcggcccagccttctcccttttcctgatcactgtagctggagacccacttcgggttatcatcctggtggcgggagcctttttctggctggtctccctgctcttggcttctgtggtctggttcatcttggtccatgtgacagaccgatcagatgcacggctccagtatggcctcctgatttttggtgctgctgtctctgtccttctacaggaagtgttccgttttgcttactacaagctccttaagaaggcagatgagggcttagcatcactgagtgaggacggaagatcacccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcctttctgacagcagccattatcctgctccacaccttttggggagttgtgttctttgatgcctgtgagaggagacggtactgggctttgggcctggtagttgggagtcaccttctgacatcgggactgacattcctgaacccctggtatgaggctagcctgctgcccatctatgcagtcaccgtttccatggggctctgggcgttcatcacagccggaggctccctccgaagtatccagcgcagcctttcgtgtaaggactga

SEQ ID NO: 78 - protein, 247 aa, Mus musculus
MGAAVFFGCTFVAFGPAFSLFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLSCKD

SEQ ID NO: 79 - DNA, 744 bp, Rattus norvegicus
  CDS (1)..(741)
atgggggctgctgtgtttttcggatgcaccttcgtcgcgttcggcccagccttcgcccttttcctgattactgtagccggagaccctcttcgggttatcatcctggtggcgggagcctttttctggctggtttccctgctcttggcctctgtggtctggttcatcttggtccatgtgacagaccgatcagatgcacggctccagtatggcctcctgatttttggtgctgctgtctctgtccttctacaggaagtgttccgttttgcctactacaagctccttaagaaggcagatgagggcttagcatcactaagtgaggacggaagatcgcccatctccatccgacagatggcctatgtttctggtctgtccttcggtatcatcagtggtgtcttctctgttatcaatattttggctgatgcacttgggccaggtgtggttgggatccatggagactcaccctattacttcctgacttcagcttttctgacagcagccattatcctgctccataccttttggggagttgtgttctttgatgcctgtgagaggagacggtactgggctttgggcctggtagttgggagtcaccttctgacttcaggactgacattcctgaacccctggtatgaggccagcctgctgcccatctatgcagtcaccgtttccatggggctctgggcattcgtcacagccggaggctccctccggagtatccagcgcagcctttcgtgtaaggactga

SEQ ID NO: 80 - protein, 247 aa, Rattus norvegicus
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFVTAGGSLRSIQRSLSCKD

SEQ ID NO: 81 - DNA, 744 bp, Homo sapiens
  CDS (1)..(741)
atgggggctgcggtgtttttcggctgcactttcgtcgcgttcggcccggccttcgcgcttttcttgatcactgtggctggggacccgcttcgcgttatcatcctggtcgcaggggcatttttctggctggtctccctgctcctggcctctgtggtctggttcatcttggtccatgtgaccgaccggtcagatgcccggctccagtacggcctcctgatttttggtgctgctgtctctgtccttctacaggaggtgttccgctttgcctactacaagctgcttaagaaggcagatgaggggttagcatcgctgagtgaggacggaagatcacccatctccatccgccagatggcctatgtttctggtctctccttcggtatcatcagtggtgtcttctctgttatcaatattttggctgatgcacttgggccaggtgtggttgggatccatggagactcaccctattacttcctgacttcagcctttctgacagcagccattatcctgctccataccttttggggagttgtgttctttgatgcctgtgagaggagacggtactgggctttgggcctggtggttgggagtcacctactgacatcgggactgacattcctgaacccctggtatgaggccagcctgctgcccatctatgcagtcactgtttccatggggctctgggccttcatcacagctggagggtccctccgaagtattcagcgcagcctcttgtgtaaggactga

SEQ ID NO: 82 - protein, 247 aa, Homo sapiens
MGAAVFFGCTFVAFGPAFALFLITVAGDPLRVIILVAGAFFWLVSLLLASVVWFILVHVTDRSDARLQYGLLIFGAAVSVLLQEVFRFAYYKLLKKADEGLASLSEDGRSPISIRQMAYVSGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCKD

SEQ ID NO: 83 - DNA, 306 bp, Mus musculus
  CDS (1)..(303)
atgaacttggagcgggtatccaatgaggagaagttgaacctgtgccggaagtactatcttggtggatttgcgttcctgccttttctttggttagtcaacattttctggttcttcagagaggcgttcctcgccccagcctacacagagcagagccaaatcaaaggctatgtttggcgctcagctgtgggcttcctcttctgggtgatcattctcgccacctggatcaccatcttccagatctaccggccccgctggggcgctcttggggactacctctccttcaccattcccctgggcactccctaa

SEQ ID NO: 84 - protein, 101 aa, Mus musculus
MNLERVSNEEKLNLCRKYYLGGFAFLPFLWLVNIFWFFREAFLAPAYTEQSQIKGYVWRSAVGFLFWVIILATWITIFQIYRPRWGALGDYLSFTIPLGTP

SEQ ID NO: 85 - DNA, 306 bp, Rattus norvegicus
  CDS (1)..(303)
atgaacttagagcgggtgtccaatgaggagaagttgaacctgtgccggaagtactatcttggtggatttgcatttctgccttttctttggttggtcaacattttctggttcttcaaagaggccttcttcgctccagcctacacagagcagagccaaatcaaaggctatgtttggcgctcagctgtgggcttcctcttctgggtgattgttctcaccacctggatcaccatcttccagatctaccggccccgctggggtgctcttggggactacctctccttcaccattcccctgggcactccctga

SEQ ID NO: 86 - protein, 101 aa, Rattus norvegicus
MNLERVSNEEKLNLCRKYYLGGFAFLPFLWLVNIFWFFKEAFFAPAYTEQSQIKGYVWRSAVGFLFWVIVLTTWITIFQIYRPRWGALGDYLSFTIPLGTP

SEQ ID NO: 87 - DNA, 306 bp, Homo sapiens
  CDS (1)..(303)
atgaacctggagcgagtgtccaatgaggagaaattgaacctgtgccggaagtactacctgggggggtttgctttcctgccttttctctggttggtcaacatcttctggttcttccgagaggccttccttgtcccagcctacacagaacagagccaaatcaaaggctatgtctggcgctcagctgtgggcttcctcttctgggtgatagtgctcacctcctggatcaccatcttccagatctaccggccccgctggggtgcccttggggactacctctccttcaccatacccctgggcaccccctga

SEQ ID NO: 88 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 89 - DNA, 39 bp, Artificial
  synthetic DNA
gagctcgaggccaccatggctgggattttctatttcatc

SEQ ID NO: 90 - DNA, 36 bp, Artificial
  synthetic DNA
gaggcggccgcgacaggaaccatcctgccatgcatc

What is claimed is:

1. A method of screening for compounds which affect the cleavage activity of EphA4 by γ-secretase, comprising the following steps:
   (i) contacting a first biological composition containing γ-secretase or a biologically active fragment thereof with a second biological composition that contains EphA4 in the presence of a candidate compound, and separately contacting said first biological composition with said second biological composition in the absence of a candidate compound, to allow EphA4 to be cleaved;
   (ii) measuring the cleavage of the EphA4 in the presence and absence of the candidate compound;
   (iii) selecting those candidate compounds which affect the cleavage of the EphA4 by γ-secretase; and
   (iv) identifying the candidate compounds selected in step (iii) as compounds which affect the cleavage activity of EphA4 by γ-secretase.

2. The method of claim 1, further comprising the step of evaluating a candidate compound as an inhibitor of the EphA4 cleavage activity of γ-secretase when uncleaved EphA4 product is increased in the presence of said candidate compound, relative to uncleaved EphA4 product in the absence of said candidate compound, in the cleavage of EphA4 measured in step (ii).

3. The method of claim 1, further comprising the step of evaluating a candidate compound as an accelerator of the EphA4 cleavage activity of γ-secretase when uncleaved EphA4 product is decreased in the presence of said candidate compound, relative to uncleaved EphA4 product in the absence of said candidate compound, in the cleavage of EphA4 measured in step (ii).

4. The method of claim 1, further comprising the step of evaluating a candidate compound as an accelerator of the EphA4 cleavage activity of γ-secretase when EphA4 cleavage product is increased in the presence of said candidate compound, relative to EphA4 cleavage product in the absence of said candidate compound, in the cleavage of EphA4 measured in step (ii).

5. The method of claim 1, further comprising the step of evaluating a candidate compound as an inhibitor of the EphA4 cleavage activity of γ-secretase when EphA4 cleavage product is decreased in the presence of said candidate compound, relative to EphA4 cleavage product in the absence of said candidate compound, in the cleavage of EphA4 measured in step (ii).

6. The method of claim 1, further comprising measuring the cleavage of APP or a polypeptide comprising an APP γ-secretase cleavage site.

7. The method of claim 1, further comprising measuring the cleavage of Notch or a polypeptide comprising a Notch γ-secretase cleavage site.

* * * * *

UNITED STATES PATENT AND TRADEMARK OFFICE
CERTIFICATE OF CORRECTION

PATENT NO. : 7,910,324 B2  Page 1 of 1
APPLICATION NO. : 12/135307
DATED : March 22, 2011
INVENTOR(S) : Inoue It is certified that error appears in the above-identified patent and that said Letters Patent is hereby corrected as shown below:

Cover page, under OTHER PUBLICATIONS, in entry Gary Fox et al.,
replace "Amen" with --Amgen--.

Column 4, Line 20, replace "include" with --includes--;

Line 31, replace "Presenili" with --Presenilin2--;

Line 45, replace "preferable" with --preferably--.

Column 6, Line 10, replace "preferable" with --preferably--;

Line 13, replace "polypeptide" with --polypeptides--;

Column 22, Line 43, replace "mat" with --at--.

Signed and Sealed this
Fourth Day of October, 2011

David J. Kappos
*Director of the United States Patent and Trademark Office*